United States Patent 7,834,146 (RECOMBINANT POLYPEPTIDES ASSOCIATED WITH PLANTS) - sequence listing, part 12

SEQ ID NO: 62245 - protein, 77 aa, Sorghum bicolor
  Clone ID: 18052570.pep
RLRSQLQNYSVVGRYLSHKPAVSARLGTQARQFTAQQNCCNTKIFLFPSTPCLFANIIGDSRTVVASLLILIIFCFS

SEQ ID NO: 62246 - protein, 44 aa, Sorghum bicolor
  Clone ID: 18052600.pep
AIREWLDSGHRTSPMTNLELSHRDLLPSHALRSAIQEWLQTNGD

SEQ ID NO: 62247 - protein, 72 aa, Sorghum bicolor
  Clone ID: 18052611.pep
WTRHLLSLACAREVVLLCCSFIDHCGLQWAVGQQLHNAHNRKRPMLCAPRLAMHARNASLCSINIVRLHIIV

SEQ ID NO: 62248 - protein, 83 aa, Sorghum bicolor
  Clone ID: 18052628.pep
VNQKNNNAWYLHASHAYIYDYMLLCLPTYNKVMVYVKYACADMLLLFVLNPRRFVLVRVGTAAASCSSRHHQIVVVWSTLSRQ

SEQ ID NO: 62249 - protein, 67 aa, Sorghum bicolor
  Clone ID: 18052644.pep
CSTHYQPQFASEYSKLYIWSSKFMLSFVVINVYIGSALVHDSSWHMLFQLIQILTYSTCINFTSFPS

SEQ ID NO: 62250 - protein, 128 aa, Sorghum bicolor
  Clone ID: 18052649.pep
MYQPYNARYGPYNGYMPQPVPAQPYFPAPYFAVGAYPYGSGYPSQGVMTNVPGMMSRRIPPAYGTYPQMYPGFNLLYRAGYGGAATSFQHGINGGSDNKKDQTSVDMQQVDNTSSVATMLEHMKLGSQ

SEQ ID NO: 62251 - protein, 86 aa, Sorghum bicolor
  Clone ID: 18052657.pep
YVGGTVVRAMPHVYDVIRRQGYVPSLKPSNVYASPLDDRFGVAWDIVVPCGAALLAVLLFLQQRLRSSDTLLFRSRRTGEYQMVST

SEQ ID NO: 62252 - protein, 105 aa, Sorghum bicolor
  Clone ID: 18052667.pep
HELVLTTKEYMQCVTAVDPQWLAEMGPMFFSVKETDTSLVDHKKRQKEEKTAMEEEMEKLRQEQAEAARMEKEKEREKRAKQQQQVAMPGLKKGATYLRPRKMGL

SEQ ID NO: 62253 - protein, 137 aa, Sorghum bicolor
  Clone ID: 18052711.pep
ERARSRPAIHSEQQTPWLSSSSRSNGNAGYSNPTRRHLPPPVDMSPTNANHSNHGVPLLNAERVQASLRKSLSFLVHLTAKFPLVFIFLLIVLYAIPASAAVLLLYVLITVLFALPSFLILYFAYPSLDWLVREIFA

SEQ ID NO: 62254 - protein, 162 aa, Sorghum bicolor
  Clone ID: 18052733.pep
GEATVSGRSKKQGEENLAVSNIANISAGLDCVSANTDLSTGSRRSRRVSSGRRSKQHTEGNNIAVPDDLNASSSAPSSSRKRKSTTGNSVAAKKRLRVSISVSADNEVETNKITNSVAVGEEGVVKKRRRRSKLVCNEGADNEVGANKIMDSVAVGEEGAVK

SEQ ID NO: 62255 - protein, 117 aa, Sorghum bicolor
  Clone ID: 18052738.pep
ARGDGRRRCRLPVGAHARPWPWPPRRRPRLSALATSGSTSPAPPACPWPPPLPPPLHRSGAAAGSPSPRAPKLVQGLGRGPGPGTWRRSGPGCPCTSRAPTTCSSLTPRAPSPAPST

SEQ ID NO: 62256 - protein, 66 aa, Sorghum bicolor
  Clone ID: 18052748.pep
YPLQRLPVSKQQFIETVKISSGLKQPNTSQTKKRGIVFYSSIRMHVRFTSAEQTRSSSVPSSKTYS

SEQ ID NO: 62257 - protein, 128 aa, Sorghum bicolor
  Clone ID: 18052762.pep
ARGKLVVSSIQDVARKLGDYAKIVSVSTNYGTKDPANSTEMLSSDSRNDVFVPEDLFLPGTLYYLQRDIEDINGVEDESYMLWKGDPGENFQRILLSGNLISDHRCESIYYALRDVLKTLPPSQAQDE

SEQ ID NO: 62258 - protein, 119 aa, Sorghum bicolor
  Clone ID: 18052770.pep
MLVRLGFVVVASVAALTLQRANNGGRHNKDNDQARKREDKARNSEHGEREEEDGEKEEEEEVKTISGIINSARSLDDDDDDMLSEIESLLSGDIDIPIPRDRFDVNGRPRYNAYMANEA

SEQ ID NO: 62259 - protein, 191 aa, Sorghum bicolor
  unsure (1)..(191): unsure at all Xaa locations
  Clone ID: 18052776.pep
HEGILHLREMELKRQAVDSSYGRKTYMAYIAEGLGSMVDWDEVMKFQRKNGSLFSSPSTTAVALIHKYNDPALQYLNLLVSEFGSSVPAMYPLKIHCQLSMVDALERMGISQHFVSEIESILDMAYSLXCWLQKDEEIMMDKATCAMAFRLLRMNGYDVSSDVLSHVAGPSTFHDSLQGYLNDTKSLLELY

SEQ ID NO: 62260 - protein, 141 aa, Sorghum bicolor
  Clone ID: 18052781.pep
TNSSPPSPAWPRSARPPPPARGRRLTPPTARRARPPTATAAELPPLPPAPDPDPAPSPLAPTPALASPHPTPTPMPAPRPRGAPTASVPPATTSTPTRTRTPAPAPAAAPLPRGVAANVPQASTPTPTRTLTPLAALRPRG

SEQ ID NO: 62261 - protein, 164 aa, Sorghum bicolor
  Clone ID: 18052782.pep
TRVGRRAAGNIWTCFAHIITAIIGAGVLALSWSVAQLGWVGGPIAMLCFAFVTYLSAFLLSHCYRSPVHSDDGSQKRQRNYTYMDAVRTHLGEKRTWLCGLLQYLNLYGTAIAYTITTATCLRAIVRANCYHSRGHDAPCGAGGDHLYMLLFGAAQVVLSFIPN

SEQ ID NO: 62262 - protein, 197 aa, Sorghum bicolor
  Clone ID: 18052787.pep
ARGKGDRKPDVSDLPHYTLGGGVCTFPDFLKAELKSSLDHLNNPCIADSREGWYHPRSIKEYYELINSCFFSDSVKVVVGNTSSGVPGYKDQDLYNKYIDIGGIPELSNIVRRESGFEIGAATPIARTIEILEEECESISSPNGSVVFRKLANHMSKVATPFVRNTASIGGNIVLAQKYPFPSDIATILLGAGATVC

SEQ ID NO: 62263 - protein, 113 aa, Sorghum bicolor
  Clone ID: 18052792.pep
MDTAVELELEQKPAVGYWSVVGARPCDACAAEPARLHCREDGAFLCPGCDARAHGAGSRHARVWLCEVCEHAPAAVTCRADAAALCAACDADIHSANPLARRHERLPVAPFFG

SEQ ID NO: 62264 - protein, 120 aa, Sorghum bicolor
  Clone ID: 18052808.pep
ESNCSARVIGSEAIAALARQVLTDVEGAAAALQVGVRQRCWLLLRDGRQHRSRFGRHRGGLVPRGDGRGWWWLRVGTRSLRCSSGWQRWWLGEPRWAAVVSCSSVASCPGHVAAGVAAGS

SEQ ID NO: 62265 - protein, 190 aa, Sorghum bicolor
  Clone ID: 18052812.pep
HEAPAPAATSDDAPPGGGGEGAGAGRLSALIRSLCAAGRTAEAARALSAAAARGGAGVVAYNAMVSGYCRAGQLASARRLAASVPVPPNAYTYFPVVRALCARGRIADALSVLDEMRRRGCAPIPPMYHVILEAACSRGGGGGFRSAVRVLQDLHGRGCALDVGNCNLVLNAVCDQGGSVDEALRLLRDL

SEQ ID NO: 62266 - protein, 113 aa, Sorghum bicolor
  unsure (1)..(113): unsure at all Xaa locations
  Clone ID: 18052827.pep
MDSKLGVQHGHHRHHSHNNGISKPPVHHHHHAGGRKGSAGSGRQGGGGGKGIKVVYISSPMKLTASAEEFRAIVQELTGRDSXVADHDLDCGAYYAAAGAPSSSSSSSSYSSF

SEQ ID NO: 62267 - protein, 117 aa, Sorghum bicolor
  Clone ID: 18052848.pep
VSTVTWSIMYCSMCLLSCVYLLPFKSVLRFVLQYTLFYIQHFSFQCFALSLLLHISQSCLNGQDSSCRTCKSQRSGTTQHTVHRAPGSSELLVPACLVWYACANAMATANQVALPRA

SEQ ID NO: 62268 - protein, 112 aa, Sorghum bicolor
  Clone ID: 18052880.pep
MELLPLLTWLLLAHAMAYLAWTAAARRRQSRCYLLDYVCHKPRDDRKLSTETAGDVIQRNARLGLTDYRFLLRVVVRSGIGEETYAPRSILEGREDTPTLKDSLEEMDAFLD

SEQ ID NO: 62269 - protein, 75 aa, Sorghum bicolor
  Clone ID: 18052892.pep
TRQLRVPAVAMAFAGGATLKLATQNVLIDVDDSTTCLAFAPTDSTTIIGNTQQQTFSVVYDVAQSRIGFAAGGCS

SEQ ID NO: 62270 - protein, 172 aa, Sorghum bicolor
  Clone ID: 18052893.pep
ARGTYQPYDGILALKMALAEFMRQIMHGSVSFDPSQMVITSGATPAMEILSFCIADPGNAFLVPSPYYPGWDRDIKWRTGVELIPVPCRSTDNFNISITALEIAYKQAKKRGVRVRGVLISNPSNPTGGIVPRETLHDLLVFAADKNIHLISDEIFAGSTYGSDKFVSVADV

SEQ ID NO: 62271 - protein, 192 aa, Sorghum bicolor
  Clone ID: 18052908.pep
TRALRNKLEARGSIFNTSSDTEVILHLIATSLSRPLLARVCDACERLAGAYSLLFLTADKLFAVRDPHGFRPLVMGRRRNGAVVFASETCALDLIDATYEREVQPGEVVVVDRRDMSVASACLVPHRPRRSCVFEHIYFALPNSVVFSHAVHERRTAFGQALAEESPAPGADVVIPVPDSGFYAALGFARAS

SEQ ID NO: 62272 - protein, 202 aa, Sorghum bicolor
  Clone ID: 18052910.pep
TRRERHNKALKTPLKEMVVVHPDNDFLEDITGKLKEYVMEEINVKTVTPCNDPLVYASLRAEPNFSVLGKRLGKDMGKVSNVVKKMTQEEILAFEKSGEISFFGHCLKLDDIKVVRQFKRPENVSEKEIDAAGDGDVLVILDLRADQSLFEAGVAREVVNRIQKLRKTAQLEPADPVDVYYESVGNDKNTLGEILKSQDQYI

SEQ ID NO: 62273 - protein, 135 aa, Sorghum bicolor
  Clone ID: 18052921.pep
MDAAAIAGQQARRRIRPPEPLVMAAAPPTPAAFRCPISLEVMRSPVSLPTGATYDRASIQRWLDSGHRTCPATRLPLASTDLVPNLLLRRLIHLHAATLPPSPSPEEVLSQLAAADADGEPAAAEKAVRSLAAKI

SEQ ID NO: 62274 - protein, 179 aa, Sorghum bicolor
  Clone ID: 18052935.pep
TRFFLKIFINTGVMLSYVSNLAFSGLPVHLSWRVMFAAGVVPTVFLAAGVLTMPESPRWLAMKGRVAEAKAVLDRTSDTPAEAEQRLLEIQDVVTNSSSGVGGGGAWKEVATKAGVRRVLAMVLTLQFFQQASGIDSVVLYGPRVLAMAGVTSNTLLLSLNVLFGVAKAGSILVAMALA

SEQ ID NO: 62275 - protein, 166 aa, Sorghum bicolor
  Clone ID: 18052942.pep
HEVEFSGAGTGAVTIRHSLLPPPFSSCMPIASKLVYFQRRPSPAPPDDPGPEPPDPRRRPCRDHHRRRRRSSLSSSHHKPGQDHVPGHQRDAAAKPLGSVGNIAEHAAGMSSSTRLHRSISDHGRLPDAVHQARERLLQRLNSVDLSGRKQKTWPSESFWAGLTRT

SEQ ID NO: 62276 - protein, 99 aa, Sorghum bicolor
  Clone ID: 18052943.pep
PLHLASFHHQRLLEQHMFSIACFGLSVLRILRPPAPSARLCRCGCFSSLVIPAIAQLESTAAYVVGRLGSWRGQIQRQCSSQVEGETSQSHHPAWSPRA

SEQ ID NO: 62277 - protein, 189 aa, Sorghum bicolor
  Clone ID: 18052949.pep
MAAAAAAASSSAAACFLSPLPPPRRPRHFLRHLARAAATKPAPAPAPASASSPWPWARRLGSLVPGETAGRLLSSAAGSLIVALASASLVLGDAGAASAFVVSTPRKLQADELATVRLFQENTPSVVYITNLAVRQDAFTLDVLEVPQGSGSGFVWDKSGHIVTNFHVIRGASDLRVTLADQSVYEAQV

SEQ ID NO: 62278 - protein, 164 aa, Sorghum bicolor
  Clone ID: 18052964.pep
HEEHTVRNAIRSKSGAIAALRELLSHNLLRSTLLLWFVYYACSFAYYGIALLSSQLSDVNRSCKSGLIFEVHQNDGNLYKDTFITSLAEIPGLILSALLVDRFGRKATMWSLMFACCAFLGPLVLHQNELLTTTLLFGARACGTGTTTILCLYAPEVYPTSVRS

SEQ ID NO: 62279 - protein, 179 aa, Sorghum bicolor
  Clone ID: 18052968.pep
ARGADEARSMDLADRYLNSECVMQMLQADQVGLAEKTAVLFTKDGDQHNNLHDMQCMWYELASGESYYRQGDLGRALKNFLAVEKHYADMTEDQFDFHSYCLRKMTLRAYVSMLKFQDRLHAHEYFHKAAAGAIRCYMKLHDSPTKSSTEENDEMSKLPPAQRKKLRQKQKKAEARAKR

SEQ ID NO: 62280 - protein, 172 aa, Sorghum bicolor
  Clone ID: 18052980.pep
HEGLKNACYDAGFPRPDGYPCPTLFANWFPVYLSIVSDDSGTDELEVAFWRGGQVSEEGLAWLLQKGFKTIVDLREEDVKDDLYLSAVQEAVSSGKIEVVNMPVEIGTAPSAEQVQQFAALVSDGARKPIYLHSKEGVSRTSAMVSRWKQYVTRSERLAVQNHSLNGNGKVL

SEQ ID NO: 62281 - protein, 111 aa, Sorghum bicolor
  Clone ID: 18052984.pep
SDSDSEVCDADRRIPPPTASSMAQRPRRSSLASSYSSPLVSHQTCARPAPAPAPPPSSRPDLARAPASERSGALTRPREEGRGGPSRTEQDTAARISMRVATTTPAGWPRA

SEQ ID NO: 62282 - protein, 176 aa, Sorghum bicolor
  Clone ID: 18052988.pep
TRGLFAKDNKKKLVLCDDKLKNLFRRSKVRYNRIFSLLGKHIAVDMTSEDETFVNSDNNNETFVRKKTRIGNYSSNTPEINKKCFAALVRHNIDLIYLKKSLVVDLLKEPDTFDSKVIGCFVKVKIDPYDYSFYMHKTLRQHKKLHQLGLVTGTRKSSEEYKINNVSTDVILCISS

SEQ ID NO: 62283 - protein, 111 aa, Sorghum bicolor
  Clone ID: 18053005.pep
MDRRDGSKAPALAAVNGTGGGVERGGVDATFDTNTVILLAAGFLALLFAIALNSLARCALWCGGRAADGGGGGGEGASSSSVGGASSCAGVRGGIKKRALRSIPVEVYVGR

SEQ ID NO: 62284 - protein, 131 aa, Sorghum bicolor
  Clone ID: 18053032.pep
MATNKDLCTVERRGRVHLITITGAGEHRLNPDLLAALRSAVAASAGAGALVLAAEGKFFSNGFDQAWARTAPPHLHSTMDGGLLALVADLLALRMPTVAAVTGHAAAAGCALALAHDAVLMRRTRGFLYMS

SEQ ID NO: 62285 - protein, 65 aa, Sorghum bicolor
  Clone ID: 18053084.pep
LLDEVDAFCNDGWWVGVVSKVLGEKRCMVYFRPWKEENEFEHAQLRLHSDWMGGRWMRASPALEM

SEQ ID NO: 62286 - protein, 74 aa, Sorghum bicolor
  Clone ID: 18058928.pep
HEAGIHCEKLAIAFAVSNSPPFRNIRIIKTLRMCSLCHVFAKLVSEKYERQILIKDSNCLHKFKNGKCSCEDYW

SEQ ID NO: 62287 - protein, 170 aa, Sorghum bicolor
  Clone ID: 18058931.pep
HEGLGHLARGCTGLEKLSLVWCSAISSTGLVRIAEHCKKLTSLDLQACFIGDPGLTAIGVGCKLLRKLNLRFVEGTTDEGLIGLVKNCGQSLVSLAVANCQWLTDASLYAVGSHCPNLEILSVESDCVRSFGIISVAKGCRQLKTLKLQCIGAGDDALDAVGSFCPLLEI

SEQ ID NO: 62288 - protein, 163 aa, Sorghum bicolor
  Clone ID: 18058953.pep
HEGFLVSDISEWLDKYRVFKVEELERGTGGFDDAHLVNGSVYKANIDGVVFAVKKMKWDACEELKILQKVNHSNLVKLEGFCINSATGDCYLVYEYVENGSLDLWLLDRDRAQRLNWRARLHIALDLAHGLQYIHEHTWPRVVHKDIKSSNVLLDARMRAKIA

SEQ ID NO: 62289 - protein, 173 aa, Sorghum bicolor
  unsure (1)..(173): unsure at all Xaa locations
  Clone ID: 18058988.pep
TRGDRRAGPSLSAFNYDSNYGKKALTMMYRGIMEQVTXDAFPVVPFGCSENQATLEEFITKAKAALVSVGIIRDPIMCNGKNGGKLTGRILDSDMHDVARFLNRILGLFPDIQNRLFDLFTSILDIVIQNARIEGQLDSGIVDIKAXSVEMKESPKTVHVDTVSGASTVLYTF

SEQ ID NO: 62290 - protein, 202 aa, Sorghum bicolor
  Clone ID: 18058991.pep
ARGTFEPVPESSVSTVDDRTPEDKERWWRRGLRAISEGKLAVVLLAGGQGTRLGSSDPKGCFSIGLPSRKSLFQLQAERILCIQKLAAQCTDAPGSTVPIHWYIMTSPFTDEATRKFFETHRYFGLEPNQVTFFQQGTVPCVSHDGRFIMETPYKVAKAPDGNGGVYAALKSKRLLDDMAAKGVKYVDCYGVDNVLVRVADP

SEQ ID NO: 62291 - protein, 110 aa, Sorghum bicolor
  Clone ID: 18058992.pep
MVLFDDDEDNIMNQFFEDDDESDDDALILSLIAIDEEDERRKKRRRGSVHGREVVYRDIHGGNLRLVADYFADVLVYNDKFFRRRFRMSRNLFLRIVEGVEAHDDYFRQR

SEQ ID NO: 62292 - protein, 176 aa, Sorghum bicolor
  unsure (1)..(176): unsure at all Xaa locations
  Clone ID: 18058994.pep
MTEAAVTRYWCHGCEKAIEEAMGEEIKCPFCDGGFIEEMIGEEFEGLVSQQSERDLSQWGTSNNPFEQPGSAADSEDEDDDDDDIGREFEGFIRRHGRASALRRVLDSIQDDLRADRERDHSVLINAFNQALALQGSVLDADEARDDQGGSNNDDGLLEEYVLXAGLSLLLQHLAE

SEQ ID NO: 62293 - protein, 64 aa, Sorghum bicolor
  Clone ID: 18059020.pep
HEVLISHIFIVNVVIYADKILRCLFDSIIATLLDFCTVPYNCCAANFLCHTIQSDLFSVFQVTK

SEQ ID NO: 62294 - protein, 171 aa, Sorghum bicolor
  Clone ID: 18059032.pep
HEGFSRREFREALGHYSQALRHVPITSDDMDVKLVSAIYVNRASTMHKLGLFKESLRDCDRAISISPNYSKAWYRKGMVKTALKNYSSAVHDLEVALSLEVTSSGKNNIEQELKLILHKHECINEAGTSNCDSKDEDLPLAGQPHKVVIESISTPNKGRGMASTDDIPPAS

SEQ ID NO: 62295 - protein, 124 aa, Sorghum bicolor
  Clone ID: 18059038.pep
MAAEAKPAAASGVAGEMEVEAYRRLFPVAFLERHLGESVRIDARRLREARPTTIALGAVSSAHGSALVRLGDTAMLASVKLEVMSPPAEHPDEGSVAVEFHMPPICSPLVRPGRSAGVAPVISK

SEQ ID NO: 62296 - protein, 161 aa, Sorghum bicolor
  unsure (1)..(161): unsure at all Xaa locations
  Clone ID: 18059048.pep
HEDFALSGFMHSSLYLLLRELISSSAQIRTASDAVLRALATAGGYCSVGQFVVANADYIIDSLCRQLRHLDLNPHVPDVLASMLCYIGASRDILPFLEEPMQAVSSELEVLGRHDHPHLTVPFLKAVSEISKACRHESTCLPDEAQSFYVKVSSEGQEVXN

SEQ ID NO: 62297 - protein, 52 aa, Sorghum bicolor
  Clone ID: 18059055.pep
NRYRMTYKKSYFFFVKIKLYYKCKSFSRRNFFGSRSITRRHCIFCLFSAYKV

SEQ ID NO: 62298 - protein, 101 aa, Sorghum bicolor
  Clone ID: 18059069.pep
ARGEVLLHVVSKIGATLTEETTKAVIAKLSDKVKNLKELPEKVEEIGKEFKAMSIVVKQFITPGHSDELVKDWIGEVRDMAHRVEDVMDKYSYHALKLDEE

SEQ ID NO: 62299 - protein, 159 aa, Sorghum bicolor
  Clone ID: 18059118.pep
ARGSLKAKISKLQSNLRMGLEIEQHLQRNARILEKRQALYDGFLRNGLSELQKFYTYQKAEIMKILEEESSQLIKVVAGIQDKLTEICINTEVNEHPANEIQCCDSSCKDVHVTTDISPSTCPKSDSPADLNSVSFDESKALAQALQEKMEALMLFSQE

SEQ ID NO: 62300 - protein, 158 aa, Sorghum bicolor
  Clone ID: 18059136.pep
ARGTRVQELEAENQRLARIASSCTCGFKESNVGSITAQHNAKFRQSSTLEKDLSFQFDHTVVSTANEVQCNVNAEGNGLPDDSSKRTKRTGRHVGNLSHCPKRLVALKVMYFGQRFYGFSSEGNTEPTVESEIFKALERAKLMVGSRRESCYSRCGRT

SEQ ID NO: 62301 - protein, 177 aa, Sorghum bicolor
  Clone ID: 18059143.pep
HEANAHVVADHTFVLVRKHGSPTKYRAEVQAVGHECDLALLTVESEEFWDGVNSLELGDIPFLQEAVAVVGYPQGGDNISVTKGVVSRVEPTQYAHGATQLMAIQIDAAINPGNSGGPAIMGDKVAGVAFQNLSGAENIGYIIPVPVIKRFISGVEESGRYSGFCTLGVSCQATENI

SEQ ID NO: 62302 - protein, 168 aa, Sorghum bicolor
  unsure (1)..(168): unsure at all Xaa locations
  Clone ID: 18059169.pep
HEALVYILEKDLESELFDLATSCKVVICCRVAPLQKAGIVDLIKSRTSDMTLAIGDGANDVSMIQMADVGVGICGQEGRQAVMASDFAMGQFRFLKRLLLVHGHWNYQRIAYMILYNFYRNAVFVLMLFWYILYTAYSATLALTDWSSVFYSLIYTSVPTVVVGILDX

SEQ ID NO: 62303 - protein, 170 aa, Sorghum bicolor
  Clone ID: 18059197.pep
ARGYDDQGCMPRFYARITRVKVIPKFLLHFVWLEFDPANKAEEAWSCRGLPVACGHFKHGQSETTKETSMFSRTISFETSKGKNCYEIYPRKGEVWALFKGWDIGWSSGAGNHKNLNHQYEVVQVLSDLTTSTSIIVMPLVKIKGFVSLFMQSREAAPYVIPHGDTLRFS

SEQ ID NO: 62304 - protein, 49 aa, Sorghum bicolor
  Clone ID: 18059206.pep
TQESETNVNATKHGTIQDRTILNGDAKVFADILPVSAAHGTESARHVQN

SEQ ID NO: 62305 - protein, 156 aa, Sorghum bicolor
  Clone ID: 18059222.pep
HEVQAHSGPAYDVRFYPDPQQPLLFSCGDDGRIRGWRWHEMQSCLVPLSLQGDHLEPALDLVNPQHEGPWGARSPIPENNAIAINKQDGSILAAAGDACAYCWDVETGKCKITFKGHADYLHSVAVRESNRQVVTGSEDGTARIWDCRSGKCMQVI

SEQ ID NO: 62306 - protein, 171 aa, Sorghum bicolor
  Clone ID: 18059247.pep
MSQAPGVAGSPYAAELAAAKKAVALAARLCQRVQRGILQSDIQSKADKTPVTVADYGSQVLVCLVLKKELPSHSFSIVAEEDSKDLREDGAQEILEHITTLVNETIVNDGSYNMSLSKEDVLAAIDGGKSEGGPSGRHWILDPIDGTKGFIRGDQYAVALGLLDEGKVVLG

SEQ ID NO: 62307 - protein, 184 aa, Sorghum bicolor
  unsure (1)..(184): unsure at all Xaa locations
  Clone ID: 18059251.pep
ARGSNGEGASAVEKHSAEMTECFLGMGTLTPALHNVQALNPSTPKECLVSNADNSDQANRSYEVHCSHNDFNVSYYPNPVLKGRISKMMYPRHWFQLPKMWLVGKCLKWKMSLPSKHVSPRKARKKTFRKQYKGPNRHIPHRTKHQKTKLIMKDRNTDPAHMRSSKTSXQFDHTCSSASLGSSP

SEQ ID NO: 62308 - protein, 69 aa, Sorghum bicolor
  Clone ID: 18059263.pep
IYKSENLPLRVMWMISPNNSQILNMPKFDLSCKIRSMSTRTVVQQHKLGRHSSPQPFHAQLNPPSYFQF

SEQ ID NO: 62309 - protein, 170 aa, Sorghum bicolor
  unsure (1)..(170): unsure at all Xaa locations
  Clone ID: 18059269.pep
TRDNTAEKGSVGGSASVPKPSKSDSCRTSSQKSFTSLLDSILQGELPCDLEKSNQTYNILSLLRVLEGLNQLSPRLKLQATRDDFAEGKVATLDGLYDVGVKVPSEEFVNSKMTPKLARQIQDVLALCSGSLPSWCYQLTKACPFLFPFETRRXYFYSTAFGLSRALHRL

SEQ ID NO: 62310 - protein, 201 aa, Sorghum bicolor
  Clone ID: 18059280.pep
TRIDSILCGSLFPPEFPMKGRVKHWVTAATYFDKVEMKALEQILLQKQRLQQEMLKYISLRQLSQEDAPDLQKRISGCFRSISRLFSDSAKCEENLNMLHQLKDADIWNIFSSLLNCSTAFEKAWSLRAEFLKILGEKHVLYNFVGTLTMRCSYLLVNKEYAKEILSEASENKTSGNTKLISSCMNLLTAISSFFPSLLSG

SEQ ID NO: 62311 - protein, 158 aa, Sorghum bicolor
  Clone ID: 18059295.pep
HEDNVFELKQKEAIKQLNRMVTEPQAAREAVELMPMGEVTNVVKELLSCGYQPDHEPYLSMLLQTFRASKLLELKTKSRIFITQGRAMMGCLDETRTLKYGQVFIQASYCADDHHKIVVTGKVVVAKNPCLHPGDIRVLQAVDVPSLHHMFDCVVFPQ

SEQ ID NO: 62312 - protein, 172 aa, Sorghum bicolor
  unsure (1)..(172): unsure at all Xaa locations
  Clone ID: 18059308.pep
HEGKEWEVVRMIQRGLKEFERRSLSSDMFAGFRARGEFVEKFKLSTKSLNKDYQESKEVPPLHLTEILAYLVRQSGPFLDQLCIRRDLCDKLVEMLYSKRNGRLMYHSLSQDRPLAENMTDELDLRIARVLESTGYHTDEGFWNDPAXYKISDNRRHVAIVTTASLPWMTGN

SEQ ID NO: 62313 - protein, 103 aa, Sorghum bicolor
  Clone ID: 18059315.pep
ARGRPAEDADTGERRCRHAPSRGRRHRGTLLPSRAQPRTPTPGNAAAVTRPAEDAGTGERRRRHAPRRGRRHLNIPAGLRWVIREKPALRLATYQTLSVVKAP

SEQ ID NO: 62314 - protein, 158 aa, Sorghum bicolor
  Clone ID: 18059330.pep
TRRLPALCRDTKLVSLLADELAITPREMRRMQNLEELSKVLMGPDGSLASELAVHVTKLGPLRMLGIRFSHMQRHSAGDRQGVMRLLEELRKSNLQSLLLDNYPHPLLGLLVDLSTHNLRKFELRIRGCLPQVPQEIASLTAVTHLHINVEAVEAQGV

SEQ ID NO: 62315 - protein, 102 aa, Sorghum bicolor
  Clone ID: 18059344.pep
MAAAEVYSPTAAAAAQQQQRGKAASQAWRAVVGWIGFLLQVLLQILRGTPSCAQLLSFIGFRYPLLSGPAASEPSPEVAFMPLHSEIPADTDAAPAPIPAPE

SEQ ID NO: 62316 - protein, 201 aa, Sorghum bicolor
  unsure (1)..(201): unsure at all Xaa locations
  Clone ID: 18059348.pep
HEADLFKGGLLKPCGGILLFGPPGTGKTMLAKAIANDAGASFINVSMSTITSKWFGEDEKNVRALFSLAAKVAPTIIFVDEVDSMLGQRARYGEHEAMRKIKNEFMSHWDGLLSKTGERILVLAATNRPFDLDEAIIRRFERRIMVGLPTQESRELILRTLLSKEKIEENIDFKELATMTEGYSGSDLKNLCVTAAYRPVX

SEQ ID NO: 62317 - protein, 170 aa, Sorghum bicolor
  unsure (1)..(170): unsure at all Xaa locations
  Clone ID: 18059356.pep
ARGLKSRISSQLTAVAKELAVYGDPVDSKAGQGAKLLNILAKYCEAFSSMVEGKNEDISTIELSGGARIHYIFQSIFVKSLEEVDPCEDVTDEDIRMAIQNATGPRSALFVPEVPFEVLVRRQISRLLDPSLQCAQFIYDELVKMSHRCLATELQQFPILRRSMDEVIXK

SEQ ID NO: 62318 - protein, 147 aa, Sorghum bicolor
  Clone ID: 18059383.pep
TRPNRGLDAPRNMFSAFPAAVMENQSIPSAPVAQSWISFGATTENKPTIVSPTFLDNNCGWKMPFANVQPSDDTKISAVPQFFRHPVQVVRENSVQNKGLVIFPQLVQPDFVRSQGQPQWQGLVPHMQQKDVLRPDLNIGFPSPGSP

SEQ ID NO: 62319 - protein, 117 aa, Sorghum bicolor
  Clone ID: 18059407.pep
TRGSYPSLNNSKTASAVVKANSQETGMGSFMYGGAQVIGAAGLSQGDQNFPGTPALLPVMQFGGQHPGGLGVPTVGMALPGYVAQQQMGMGNNEMAWLPLLAGATGAFGGSYPPYIA

SEQ ID NO: 62320 - protein, 169 aa, Sorghum bicolor
  Clone ID: 18059415.pep
TRLFKVNYGAEVAQLKHSLRTLELASQELRTKGLFFKLLEAVLKAGNRMNAGTARGNAQAFNLTALRKLSDVKSTDGSTTLLHFVVEEVVRSEGKRLAINRNHSIRRSGSLARSGHEGGSSAAGFASQGPSREERQNEYMNLGLPIVGGLSTEFANVKRAALVDYDAVV

SEQ ID NO: 62321 - protein, 131 aa, Sorghum bicolor
  Clone ID: 18059417.pep
RGEASELRKPQGSERSGQPSPPPRPAAMAATGVVAEPKTKYDRQLRIWGDQGQAALEKASICLLNCGPTGTEALKNLVLGGIGSVTVVDGSKVEASDLGNNFLLDEGCLGQPRAKSICSFLQELNDAVKAK

SEQ ID NO: 62322 - protein, 86 aa, Sorghum bicolor
  Clone ID: 18059428.pep
ARGRRRIGVTATGERATITLERSDRRRRTQTWILIYLERTRFADCEAQSSKSSGGGLRCAVRLAAVGCPTCLPREDWGHLARRPPH

SEQ ID NO: 62323 - protein, 147 aa, Sorghum bicolor
  Clone ID: 18059435.pep
MRSSVPRLFITQPEAYLQDLPAYESGWNWQRLREISRFYPDSQATVPEADAREDYWMWNDQLDETPSAQSSLSIRQAGQRVSASPSLHQIAMQSSMRSSSPMMIRGQTPARERRSSKPPYIRTTSLPPAVPANISPSQRIRRRVSSF

SEQ ID NO: 62324 - protein, 151 aa, Sorghum bicolor
  Clone ID: 18059442.pep
ARGHKYQLRDAGGVDCAKCARSTRAAMAPPSPVWTAPIHTSQNVSDRRDIPVKSWRPPAGQISSQWRQTNLWSMSSVQSDLQQRLAFEFDRPSGSEKLLPGRTFIHAQERKFDDMHDRPTTPVGMNHIIRERDPNGHGQPTNMDPAYSYTL

SEQ ID NO: 62325 - protein, 83 aa, Sorghum bicolor
  Clone ID: 18059457.pep
SPLAHCACHVLALIYALLGSQAHITRPLLCDTIFSVFLHLHVWVHGAVCPRKMSAQGWQLISHMKGRTGAVSAYDMEEHGKLD

SEQ ID NO: 62326 - protein, 192 aa, Sorghum bicolor
  Clone ID: 18059462.pep
SVERILQYISIPTEPPLVMSENKLAHNWPSNGEIQLHNLHVKYAPQLPFVLKGLTVTFPGGMKTGIVGRTGSGKSTLIQSLFRIVDPTVGQILIDGVDICTIGLHDLRSRLSIIPQEPTMFEGTVRSNLDPLGEYSDDQIWEALDCCQLGDEVRKQELKLDSPVIENGENWSVGQRQLVCLGRVILKRSKVL

SEQ ID NO: 62327 - protein, 88 aa, Sorghum bicolor
  Clone ID: 18059474.pep
MSAGSERPYTFATPSVVPGPFSRGSGSAPTPTAAATDSTGRSSSSGAPTKSRKPPFRLAVDDTKPVLRDPISRSDLADTEQVVLRLPP

SEQ ID NO: 62328 - protein, 80 aa, Sorghum bicolor
  Clone ID: 18059478.pep
MDPVFADLAKKNPNVVFLKVDVDVGEMSIIAKQLSVNGVPTFLFMREGTVKDRVLGADKEELEEKLLEQLSLMPWLRLYV

SEQ ID NO: 62329 - protein, 177 aa, Sorghum bicolor
  Clone ID: 18059502.pep
HEDQAERFKVLSYNILADYLAQEHQFLYERIPSFILDWNWRKDKLLFEFGLWSPDILCLQEVDKFTDLEQEMASRGYNGTWKIRTGDAADGCAIFWRTTRFQLRYEEDIEFNKLGLRDNVAQLCVLESVVPQNVQTDSTSLSTSSNDPQQAKQVVICNIHVLYNPKRGDIKLGQVRT

SEQ ID NO: 62330 - protein, 133 aa, Sorghum bicolor
  unsure (1)..(133): unsure at all Xaa locations
  Clone ID: 18059505.pep
ARGDDMCLSPEPDGTVGKPTFEDNFEEQNIQKGSSWENGITMKSSWEQDASAANDSGDWGGWSSGGGASAKPADQDNSWEVHAKVQDNSTDWGGWSSGVGAAAKPADQDNSWEVHAKAQDNCTDXGGWSTDKP

SEQ ID NO: 62331 - protein, 142 aa, Sorghum bicolor
  Clone ID: 18059528.pep
TRITLKKFFIPSLKSWTRRVVAEGDENANDELASKLCEEIREAIKVSTSAFSDIARTNQEVLASKDEDRKVLMKLTETFESQANVFKSLNETLNHIRENQFSRRNQLEEHVQPAPWNGPIDYQGRAFQQTNMYATPPNNSFD

SEQ ID NO: 62332 - protein, 147 aa, Sorghum bicolor
  Clone ID: 18059532.pep
TRISDSIAKQLEDVVLEERKGSKKNKVSKASSRTHKSKSRKRPAGSDGHEVDFTSTIIIGDASTNREESAMNQYNYLSSSVLVDNHPSSSQSSAKDSTQAYAEQLCEEFSEAVNIGNDETTDEKMRPALKPSLKVTGSKSGRQSVTW

SEQ ID NO: 62333 - protein, 187 aa, Sorghum bicolor
  unsure (1)..(187): unsure at all Xaa locations
  Clone ID: 18059575.pep
HEASSKQGSQSLKNYYAPRIGIPKAPKDYLQQEQLPMLVLVHAKDTSDRSTSYSSSPDEVGLTGVGSNYPTEGNEGSQPGIEIAASVSCNLVPDLAPQAASDDSHVSDPHSLCPENKGVSTSRSSKNLCTDPFAAETKEARCVKLLTENNSQECCKWYSGAGHLSQKWVPVGKKESCNXVYLDVSAN

SEQ ID NO: 62334 - protein, 138 aa, Sorghum bicolor
  Clone ID: 18059577.pep
MGRGGIGGAVGMAMENADSARAFVKDVKRIIIKVGTAVVTGQNGRLAMGRLGSLCEQVKQLNFQGYEVILVTSGAVGVGRQRLQYRKLIHSSFADLQNPQMNFDGKACAAVGQSGLMAIYDTLFSQLDVTSSQLLVTD

SEQ ID NO: 62335 - protein, 43 aa, Sorghum bicolor
  Clone ID: 18059595.pep
IVNVMMHHLSTPAHRLPLFFFNYQLTFMCNASSFSAMMLSELF

SEQ ID NO: 62336 - protein, 165 aa, Sorghum bicolor
  unsure (1)..(165): unsure at all Xaa locations
  Clone ID: 18059599.pep
ARGLVWLCHCFHHENYSAYCTSRFGRLINRPSILDVENEEYAEDRCRDVWATHFPSEPFDLDTNEIDGNSVDNITCDNVDGEIVKMVRRYADLADRFASPFVWEGVYHVAARRRYVRFLDLIKKVVCGTXVFTRLVPSLDMLLMWLAHQSFPVCYATDMLAMGIR

SEQ ID NO: 62337 - protein, 133 aa, Sorghum bicolor
  Clone ID: 18059615.pep
ARGWHSAAIVEATVQTGMNMVSKKLYTWGDGDKNRLGQGDKEARLIPTCVQALLEHNFHQLACGQNMTVALATSGHVYTMGSSDNGQLGNPKSDGKQPCLVKDKLAHELVEEISCGAAHVAVLTSRSEVYTWG

SEQ ID NO: 62338 - protein, 152 aa, Sorghum bicolor
  Clone ID: 18059629.pep
ARGFEPYIDVLELNRLRRELVLDIHVWDRRLYMMHSLTKENCRTVPNDAECSEKLTESLLEQSKDVTSGKHLNVENSLEQNQPSMLEVAAVSVKSSSPMMEQTNTCVSRLETNIMGDLSMHSGSTVISFAPGPCEMQSEGVLAELEAGKFLQ

SEQ ID NO: 62339 - protein, 89 aa, Sorghum bicolor
  Clone ID: 18059644.pep
WKTKGLARLLRPSSMGKLSCRSLCACCMGPPRAASPAGAAVDATAGVTVKVTDRYVEIKNGIFELTLSNPDGIVTGVRYNGVDNLMEIL

SEQ ID NO: 62340 - protein, 203 aa, Sorghum bicolor
  Clone ID: 18059702.pep
ARGAGGGGASSLPPFLSKTYEMVDDPATDAVVAWTPPGTSFVVANQAEFCRDLLPKYFKHNNFSSFVRQLNTYGFRKIDPEQWEFANEDFIRGQQHRLKNIHRRKPIFSHSSHTGSGPLADTERRDYEEEIERLKSDNAALTSELENNAQKKLVTEKRMQDLEDKLIFLEDRQKNLMAYVRDIVQAPGFLASFVQQPDHHGKK

SEQ ID NO: 62341 - protein, 129 aa, Sorghum bicolor
  Clone ID: 18059734.pep
HEAFDEKFVRIETERLCELTSAADSLQLKPLVDLTSRALARIIEGKTPEEIRDIFHLPDDLTEEEKLEPLKNINDDPRIRLLNRLYAKKRKELQERHQRQKLKGVQVQKEQKDERSLDELLCFINGDGG

SEQ ID NO: 62342 - protein, 163 aa, Sorghum bicolor
  Clone ID: 18059746.pep
HEGEEVLLTSSGAVLSALPSALLAEAQMLRDRELSRYRARGSLFGGSYRLGGRRLPTDNQTIIDRAVGVTVGRRVISTTPGGSKGKDVEGTPLLDSEALRALIRLLQLAPPLSKGLLQRLMFNLCAHSVTRVTLVGHLLDMIKPESEGLSVSDCMATYRLHGC

SEQ ID NO: 62343 - protein, 145 aa, Sorghum bicolor
  Clone ID: 18059759.pep
HRTRSVHTGLKRREVRKTRRAPDAEHWTVWCSPDLNPKSNAKWTSHRTRTTGRTSLRSVPIVRCLTLAGPDTNYTGRTESAFPVPQKPARDFSKRPTSAIENMHFIFSESVESRQACEAGGREEPIFSLPFKLHLLPKVCQHHNV

SEQ ID NO: 62344 - protein, 132 aa, Sorghum bicolor
  Clone ID: 18059767.pep
TRPKDLNRSWEDPMSSGGRYLMQELVGTGLSAQSVPEWKMTYGKAGTYGQKSRLSIQEQRQSLPIFKLKKELINAVNDNQVLVVIGETGSGKTTQVTQYLAEAGYTTKGKIACTQPRRVAAESIAKRVAEEV

SEQ ID NO: 62345 - protein, 151 aa, Sorghum bicolor
  unsure (1)..(151): unsure at all Xaa locations
  Clone ID: 18059788.pep
ARGSCSLYLVFDYMVHDLAGLAASPDIKFTLPQVKCYVHQLLSGLEHCHNRGVLHRDIKGSNLLLDNNGVLKIGDFGLASFFDPNHKQPMTSRVVTLWYRPPELLLGATDYGVGIDLWSAGCILAELLAGXPIMPGRTEVXQLHKIFKLCG

SEQ ID NO: 62346 - protein, 61 aa, Sorghum bicolor
  Clone ID: 18059795.pep
LMAIFLIRFSHLSSMNPCLQIVSSLVHLGSRKLRQANFTEWCQFNLVVVASHYLIVSSYFE

SEQ ID NO: 62347 - protein, 150 aa, Sorghum bicolor
  Clone ID: 18059803.pep
ARGDLIVQRVEFVLDSDKRSYLMDLLHAQKANGTHGKHALTLVFVETKRGADALEDWLFRNGFPATSIHGDRTQQEREHALRSFKSGATPILVATDVAARGLDIPHVAHVINFDLPNDIDDYVHRIGRTGRAGKSGLATAFFNESNTTLA

SEQ ID NO: 62348 - protein, 124 aa, Sorghum bicolor
  Clone ID: 18059811.pep
ARGTSGVFQVEPKSCPGFIFRRSVCVGTTHMSRSQVHTSIEDLAEDYHGDTYHLIVKNCNHFTADVCKRLTGKPVPGWVNRLARLGSFFNCVLPDSIKVSAVRDVNTHPDFSDDDLGSNASILE

SEQ ID NO: 62349 - protein, 93 aa, Sorghum bicolor
  Clone ID: 18059843.pep
LQPVLIISMQAFAFTDLPWLLTCAESPAVTREDEPSPVTHPAAARVNKTRQVAREHRTPRLVGLRMNETTPPEVETDGTKKRRPPLRTSRPSC

SEQ ID NO: 62350 - protein, 114 aa, Sorghum bicolor
  Clone ID: 18059847.pep
MATAVASPTFLSSAFAPRQHRRLTRLAGPRRAAPVGLAVRCEKSDKQKRQPLSALVPREQRFMFEGDELCGPDIWNTTWYPKAADHVTTEKTWYVVDATDKILGRLASTIAVHI

SEQ ID NO: 62351 - protein, 78 aa, Sorghum bicolor
  Clone ID: 18059853.pep
RCAGNQFGRYNCSKIFLLHSSAVDSPHHLSEVHDYQSRGRYLFVCCFFLKKIFACYLRFFFFRHGCAQEKRYGRFCGR

SEQ ID NO: 62352 - protein, 177 aa, Sorghum bicolor
  unsure (1)..(177): unsure at all Xaa locations
  Clone ID: 18059866.pep
HEVLDHIQGEDLVVRCYYIDSAMKAFAISPAQLYSNTPSDFDFKLESLAQGFDSLSDFAEHLAINVDIVFPVIHGKFGEDGGIQELLEKANVPFVGTPSKECERAFDKHNASLELNAQGFLTVPNFLVEKDKLAKPELEAWFKTVNLNKEXGKVIVKPXRAGSSIGVVVAYGVNDAA

SEQ ID NO: 62353 - protein, 188 aa, Sorghum bicolor
  Clone ID: 18059872.pep
TRDKGKGKMRVKDSGCSMRSPLLDCSLCGATVRIWDFRSVPRPSHFSLNNIDMPDTGRKPVLIRGISATSGINGLVAEGAERENVEGRGEAGIDEGKSLSNAQVDLNLTMAGGLPSNYSALPPMPGHLNYGGMGRDLVIGQPTGSELGGHAASFESRGPSSRKRNLEEGGSTADKPINRLQPADSIEG

SEQ ID NO: 62354 - protein, 159 aa, Sorghum bicolor
  Clone ID: 18059887.pep
ARGSTLSETLRFTYSETLGKWPIGDLAFGISFLLKRQGNLSVASIYAGNDSVELKGAEVIADLKYLLNLLTLCWHFSKKPFPLFLEATGYSVEDVLMQEPKAGILKPAFTILLDRDKKSILLLIRGTHSIRDTLTAATGAVVPFHHTIVQEGGVSDLVL

SEQ ID NO: 62355 - protein, 178 aa, Sorghum bicolor
  Clone ID: 18059891.pep
ARGIKVKMMDHGDGDRGWDVFSLEYDARVPLDTVFTASVMKMYLKVFNFLWKLKRVDHSLTGVWKTMKPNCIVSSPFYKEGTSIRAQFVSVLRKCQVLFNEMNHFVTNFQYYIMFEVLEVSWARFSDEMDAAKDLDDLLLAHDKYLNSILEKALLGERSQGLLRNLFELFDIILQFRS

SEQ ID NO: 62356 - protein, 137 aa, Sorghum bicolor
  Clone ID: 18059899.pep
TRLDREVAESLPISNATEGEDAGAELCSDDSDAKGSTEVGGHNKEDEEADGYHDASNDLKSIPISSSDDAVEFIAKELEDNVPTSRGARFGVEDSDDAEINGDDEYEEEMNVKEAELFDYAALIELLRAASSSPEQG

SEQ ID NO: 62357 - protein, 43 aa, Sorghum bicolor
  unsure (1)..(43): unsure at all Xaa locations
  Clone ID: 18059949.pep
NLTHPXSMWFGIDNLNNMMVLGILFTYLVFTVVRNQFRHFRCL

SEQ ID NO: 62358 - protein, 50 aa, Sorghum bicolor
  Clone ID: 18059999.pep
NPRMTYIWDWGSTLAVYCRTPGLHACFITVSLFLSRELTFFIISHSLCVL

SEQ ID NO: 62359 - protein, 175 aa, Sorghum bicolor
  Clone ID: 18060001.pep
HEAIENVNNLIGFKCHRCRLRSLPVCPYAETVTILKGQSDKDHGIKFVDNSVDKFVEDEDPNCPKDLGALGSLQELHDHDIERRLNGHITEIEFSYNNCLEELNDHGSLKEFDAHSTEKDLEDDESLKKLDTHNELKELDDPGSKKEPGDHYCPKDLNSDTNLKDLDNCRTDKEI

SEQ ID NO: 62360 - protein, 89 aa, Sorghum bicolor
  Clone ID: 18060005.pep
GTRFCSRKWWTWSDLRVAFVRVGHDASVFSMWLVRLCRAVQAARPRQMVGECSHLSDLLPCLSASVILKRFHLGRQIVTWNKVSRPGHV

SEQ ID NO: 62361 - protein, 170 aa, Sorghum bicolor
  Clone ID: 18060053.pep
HEVETSDRSQGAKSANEVALHDSGAKDHDTSTLGHSCADNENSVADEDSTITDMSHMDSILPSCVPDDPSNNHETVVPRGAVVAEKNGEENKVENHQTVYTEEGTTSGVSTKDAEGSSISRSAEEVHEEVLDKDKLIISLEEEVKCLKARLDHLEQHNHLVTESTSGIEY

SEQ ID NO: 62362 - protein, 119 aa, Sorghum bicolor
  Clone ID: 18060064.pep
TRLQFTFQELKSATLNFRPDSILGEGGFGYVFKGWIEPNSTAPAKPGTGVTVAVQSLKPDALQGHREWVAEVDFLGQLHHKHLVKLIGYCIEDDQRLLVYEFMARGSLENHLVRTALPL

SEQ ID NO: 62363 - protein, 160 aa, Sorghum bicolor
  Clone ID: 18060067.pep
MAIATNNFDLSAQVGQGGYGKVYKGILADGAVVAIKRAHEDSLQGSREFCTEIELLSRLHHRNLVSLVGYCDEKDEQMLVYEFMSNGTLRDHLSAKSKRPLSFGLRLKIALGAAKGILYLHTEADPPIFHRDVKASNILLDSKFVAKVADFGLSRLAPVP

SEQ ID NO: 62364 - protein, 191 aa, Sorghum bicolor
  Clone ID: 18060079.pep
HEAEAISRIRNEKAKRYLSSMRRKRPIPLTQKFPNADPLALRLLEKMLAFDPKDRPSAEEALADPYFKNIANVDREPSAQPVTKLEFEFERRRITKEDIRELIYREILEYHPNMLREFLEGTESTGFMYPSAVDHFKKQFAYLEEHYAKGSTAAPPERQHNSLPRPCVLYSDNLTKSTAHVMEDLSKCVIR

SEQ ID NO: 62365 - protein, 145 aa, Sorghum bicolor
  Clone ID: 18060088.pep
ARGPNVRAKGVASTKAAELLNNMQLEDPVNMDDMGIPEINTVILLDREVDMVTPMCSQLTYEGLLDEMLQINNGSVEVDASIIGAQQDGKKVKVPLNSSDKLYKEIRDLNFEVVVQVLRQKATSIQQDYAEVKSTNTQSVSELKD

SEQ ID NO: 62366 - protein, 113 aa, Sorghum bicolor
  Clone ID: 18060104.pep
MEAAPAALRRPAGSDDAADPPRCPPAPAAAGSGAMSGGAATKLQKVYRSYRTRRRLADSAVVVEELWWKALDFARLNYNTISFFDEPKPKTAASHWNRISQNALKVGHGLSRD

SEQ ID NO: 62367 - protein, 73 aa, Sorghum bicolor
  unsure (1)..(73): unsure at all Xaa locations
  Clone ID: 18060111.pep
HEAVSGEAIDRWTPRRADSFEKIDKIGQGTYSNVYKARDTVSGXKIVALKKVRFDNLEPESVRFMAREILILR

SEQ ID NO: 62368 - protein, 36 aa, Sorghum bicolor
  Clone ID: 18060126.pep
RRAGEEAHHAAGGRSAQGRQAAGDDRRSRRSSAPRA

SEQ ID NO: 62369 - protein, 110 aa, Sorghum bicolor
  Clone ID: 18060131.pep
RIWPSPPVSPYTPPDQPSRHSALSLSLSLSLVPLAYSYSSLFPQLLLPATSLAFPHCSAPSDRSLLPPPSRSTMLQLTRASSELRTGSSTSSDRSSCRSLASSPPVLPLV

SEQ ID NO: 62370 - protein, 169 aa, Sorghum bicolor
  Clone ID: 18060173.pep
MDAFLQRLKRLDAYPKVNEDFYKRTLSGGIVTLVAAVVMLLLFISETRSYFYSATETKLVVDTSRGERLRVNFDITFPSIPCTLLSVDTMDISGEQHHDIRHDIEKRRLDSHGNVIEARKEGIGGAKIERPLQKHGGRLDKGEQYCGTCYGAEESDEQCCNSCEEVREA

SEQ ID NO: 62371 - protein, 194 aa, Sorghum bicolor
  Clone ID: 18060183.pep
HEGKKVSGASIFFESMSYKVNPQTGYIDYDKLEERAMDFHPKILICGGSSYPREWDFARMRLIADKCGAVLLCDMAHISGLVAAKECRSPFDYCDVVTSTTHKNLRGPRGGIIFFRKGKNLRKRAGSFSQGDDNEYDFEDRINFGVFPSMQGGPHNNHIAALAITLKQVATPEYKAYIQQVKKNAQALASALLK

SEQ ID NO: 62372 - protein, 61 aa, Sorghum bicolor
  Clone ID: 18060185.pep
SFTENNKYKHNYKLNGFCKRTDNYTVVAFYLGKYPGCRFIFIPPGRLRVKLYSIILIRMNK

SEQ ID NO: 62373 - protein, 184 aa, Sorghum bicolor
  Clone ID: 18060192.pep
MVLYQNQKDSYQVCQDHKSETRKADCIRRESDCRSTDSEVQRSKQKTEVASNSIFEHQSLCKNMAEIMNVSKTRLCGKILKKLMDHKGGWLFHKPVDPVLYGIPDYFYVICNPMDLGTVKKKLTNKQYVTASEFAADVRLTFSNAMKYNPPGNDVHAVAEQLNRIFDSEWRTVVRKWSGRKPIQ

SEQ ID NO: 62374 - protein, 155 aa, Sorghum bicolor
  Clone ID: 18060195.pep
HEGRVNAMLVRRLELLGEVSKLARSLRLPEDVGYTCETAAYFWLLHVYARWEQFLAACAQNQDKPSFVKDRFPFSEFFSDTPQPIFTGESFEMDMHAAKGCFKHLSIIFQELEECRAFELLKSTVERANYLMTKQAKIVAMTCTHAALKRRDFLQ

SEQ ID NO: 62375 - protein, 91 aa, Sorghum bicolor
  Clone ID: 18060227.pep
LDSWIVEHGNLQPSLVNSQEECNGGCNWHLHFRPLCGLHFGDRRIHVSYVYGLQQRLGRYYDFNSYILIGLWTTRLCCSPYSNSLVFWFVL

SEQ ID NO: 62376 - protein, 137 aa, Sorghum bicolor
  Clone ID: 18060260.pep
ARGRKTVLLLSTLLTSGMGFLSALSPNYLCLLVLRFFVGIGVGSGHVFTSWFLEFVPAGNRGTWMVIFSFFWTIGTVLEASLAWAVLSALSWRWLLALTALPCFLLLPFFRITPESPRYLCAQNRMTDARLVLERIA

SEQ ID NO: 62377 - protein, 181 aa, Sorghum bicolor
  Clone ID: 18060268.pep
TRDISRCISLRKLPQTILKLPNLESLVVRGCFPRIEEQIKESSLANGLLSLPKFFVCTMPGGLSSNIVQLEGVNPGELEIKFLENVASLEEVKKVNLAFKSRLSKLFLSWTGSVNDHLLDDESLLGELVPPTTLEQFILQGYMGIRLPSWTGSATYLLNLSRIELLNLPRCTQLPSLGQLP

SEQ ID NO: 62378 - protein, 158 aa, Sorghum bicolor
  Clone ID: 18060274.pep
ARGFKEAKEAAPSIIFIDELDAVGGSRGRSFNDERDQTLNQLLTEMDGFDSDMKVIVMAATNRPKALDAALCRPGRFSRKVVVGRPDVEGRKKILAVHLRDIPLEENPEIISDLVARVTPGLVGADLANIVNEAALLAARRGRNTVSREDIMDAIERE

SEQ ID NO: 62379 - protein, 112 aa, Sorghum bicolor
  Clone ID: 18060280.pep
GDRARDARRGDGNGEEVESKPRARFVQGVVAEHTPGEVGRARSRDGGARMLVVLHPQGGPHGHGEGQVNLYPASPSQENLNGTPLSIEGFLFALSSRAFDRKIDMPVDTPFL

SEQ ID NO: 62380 - protein, 99 aa, Sorghum bicolor
  Clone ID: 18060284.pep
TVVFEVVTGQSRWGDAATTSWARGVIRNRKGLNLVDDRLRDETAGTDAEKEMAECLQVGFLCTAGAPEKRPTMQQVVGLLKDVRPPATTAGAGGVPPLV

SEQ ID NO: 62381 - protein, 171 aa, Sorghum bicolor
  unsure (1)..(171): unsure at all Xaa locations
  Clone ID: 18060290.pep
ARGEEGISEKAKRQIEEVFDELCPPLGLENLNIEGYFGERLPRWMMSAAAVMPLRSLRTVTMDNLACCTELPSGLSQLPCLELLQIVRAPAIKCVGHEWLQPNNQLGFAFPRLQELHFEGMVEWEEWEWEEQVKGMPILELLKLXMCKLRRVPPGLAFHARALKKLCIYGV

SEQ ID NO: 62382 - protein, 160 aa, Sorghum bicolor
  Clone ID: 18060294.pep
HEGCFLPTLQPRQRPKSQHMEGVAPAVSLFRPRASARPTIVLAENSGSARRSPGAGGRSRGVSRLSPEMSPGGASRRMSKLRKHGSREAEAAARSGITRVPNLGTAVSTKRAGMSKDTVINLDVSHHRAVAVVRLLRIEKGKAFVDLLNEKANDSGEKEI

SEQ ID NO: 62383 - protein, 156 aa, Sorghum bicolor
  Clone ID: 18060298.pep
ARGSFRSMVRDIRESFGNISRRNFEVRIHHRGKSLGSSSDLQDKPAEIQQSRWASLPPELLRDVMKRLEEDDSSWPDRKDVVCCASVCTTWRDMCKDIVRSPEHCAKLTFPISLKQPGPRDGVIQCFIKRDKSKLTYRLYLSLSSGKCQAIVFTSE

SEQ ID NO: 62384 - protein, 106 aa, Sorghum bicolor
  Clone ID: 18060339.pep
TRVIFYSIAWQGRWHHIILQQELWNTKLFFFKLIQQPLPMDRSKNWSRNRHASLLLYDLPLEVHNKIINDLLLMLVCLLIHFYLFLSISSAFFLSFYTSYYLLYFI

SEQ ID NO: 62385 - protein, 159 aa, Sorghum bicolor
  unsure (1)..(159): unsure at all Xaa locations
  Clone ID: 18060345.pep
MELVVSAVVGELVNRFMSFLFNKYKSEEQLEKKVRMLQDLVVRAHMIVEEAEARYITNSKMLLQLKKLVEVMYQGYLVLDTNRYTTVNEVSSSFSELSVTTYIKRLFTCVDHELQPALDNLESLLSNMKEFVFLLHGCERMFRGPYDSYLYIDXFMFGR

SEQ ID NO: 62386 - protein, 85 aa, Sorghum bicolor
  Clone ID: 18060347.pep
PASEAKALRGQMKIYDLTKGRQVGGLLAETRKPENIVASSSGEFLGIANKRKLHIWSIPTKDFKPDKIRKIKLRHTKNLTTLAFH

SEQ ID NO: 62387 - protein, 88 aa, Sorghum bicolor
  Clone ID: 18060359.pep
MDVQEALQRDNSALSNTVTKLNRDVAKLEVFRKTLVQSLQEDDSSDNTVPGARVAATSNFSSAPSDEDSAFPTSKSSQISETASSVSE

SEQ ID NO: 62388 - protein, 56 aa, Sorghum bicolor
  Clone ID: 18060363.pep
YSFSADSQGSSCENMILLILLQHYSVITKKSSAVCLFNGFSSSIRIPDGKLDNIVF

SEQ ID NO: 62389 - protein, 193 aa, Sorghum bicolor
  Clone ID: 18060369.pep
GGQHNLQPQAEQKEIRHLTTENLEAKDDDSKSLKSLEAPQGAQPVTSLLSKNGVVFSKNYLSRISVSHDLVESELYKRCISLLGDLGIRKASHLVRNELQDNGNIEKMSTKYGSCNPFTSRYLKGDSAIFQRALALHKNQTQKCLITASASVKMEENMDVPEDDHDEEMLELVVCNPALQCHTDVMAEGSLSN

SEQ ID NO: 62390 - protein, 148 aa, Sorghum bicolor
  Clone ID: 18060383.pep
MASWLKDAEDLLEVVDRRAKIVATELSDEQSTSQPSGPNNQEVQAKKGKPREKGPLKLTNADGGNKASAHKERRSMQPLRERMKIEKIMPSPPADSSSVDTSASEPEVTQVNVKEVGNEVTLEKGEKATDDLKTDKSGTVVNSTVEVQ

SEQ ID NO: 62391 - protein, 139 aa, Sorghum bicolor
  Clone ID: 18060397.pep
ARGSTGGIAGASSLAASPSISAGFNPSALLPFLQATKWLPCSDIVTATTTSRSSGRPARATAAPSPRTAAPSPRTAAPSSRPAPRAAALSPCPSPVPSPAVAAPSKVGIQALVGSASIASGSAVIGRGAIASGAAGMVK

SEQ ID NO: 62392 - protein, 144 aa, Sorghum bicolor
  Clone ID: 18060416.pep
MMAAELVKQFSNITLGEDNEICDVKQALKALRKKILGLDFDNSMHVHDPQDSFQYLEVLSKIKQLSEKLRTLDPGGEAKQLDELTVYAYDLSEMAMARLEEEFVYLLTHYKQPLEQEVLSFRSTEDGSAEDFSSSSFSEEQSEG

SEQ ID NO: 62393 - protein, 65 aa, Sorghum bicolor
  unsure (1)..(65): unsure at all Xaa locations
  Clone ID: 18060430.pep
DFFLQCDQLLAYCSRSSESAVVKCPQQQVCLSFIFPFFLCKSTEXVYHKYIFLKSARIGKLHHIF

SEQ ID NO: 62394 - protein, 201 aa, Sorghum bicolor
  Clone ID: 18060448.pep
HEESKAILLFQKIEGVDVCLFAMYVQEYGSDCPSPNQRHVYLAYIDSVKYFRPEIKSASGEALRTFVYHEILIGYLDYCKKRGFVSCSIWACPSTKRDDYVLYCHPTVQKMPKSDKLRSWYQNLVKKAVKEGVVVERNTLSDFFLQPTNECKANISAACLPYCENDFWPGEAERLLEKKDDNTSQKKETQVGRLLRVAKRD

SEQ ID NO: 62395 - protein, 70 aa, Sorghum bicolor
  Clone ID: 18060467.pep
TFYRLIFLLTTGPSNSSNDLLKFLETGLSRTYNDCFVEALTAEAENDKRIVVVHGGMGMDRSLRLFQSRF

SEQ ID NO: 62396 - protein, 61 aa, Sorghum bicolor
  Clone ID: 18060511.pep
GNKWSLVLESLPVASSNSTDLMGGLNLDLKCEKIGGEFHARSAFPPETGISRGTPNLTWEC

SEQ ID NO: 62397 - protein, 159 aa, Sorghum bicolor
  unsure (1)..(159): unsure at all Xaa locations
  Clone ID: 18060513.pep
HEGLLAQEYALIRGVRGDIQYINDELASMKAFLLDLTQDDHDNRKKDWMKQIRDMAYDCEDCIDDFAHRLPKDSNFSGKCCCPWLAALLYDLWTCWPRHEIASNIAELKVRAQLIADRRMRYGVESPKGRESNDSSDDVPXYDEIAEDQLPRREMTMKE

SEQ ID NO: 62398 - protein, 128 aa, Sorghum bicolor
  unsure (1)..(128): unsure at all Xaa locations
  Clone ID: 18060553.pep
ARGNNNPEMLGDEIELDIDEMDVETQWELDRFVTNFNKALXKSQRAAMMNGGAADVTSAAEAEDDTAPVGDVPALVDNDDAESDKPVKSTAMAEQVDEYVDIGDDMPTATYQAMEIQKDAEGVTGSGG

SEQ ID NO: 62399 - protein, 56 aa, Sorghum bicolor
  Clone ID: 18060558.pep
TKKTLLNSVAHSSRTKYHTADHPYYMGWFIKFTKVNPVPHTFPTSCLHMLLTFCFI

SEQ ID NO: 62400 - protein, 139 aa, Sorghum bicolor
  Clone ID: 18060582.pep
TRCQVNLQRVQMKYKNEAQLVEDGTTLSGFQQTSSRFESSDDDYADSDDTTTEQPYIRPAVFHPRFPANKLSVIPPLRIKRERELKRRPQQNGWVFKRDPEEPVFLFTRPLDPEKLVAAGIKPPPDPPIENGAASPPFR

SEQ ID NO: 62401 - protein, 135 aa, Sorghum bicolor
  Clone ID: 18060634.pep
TRLNNLAQIGMSVGANDTTILLCLFGFCNFVGRILGGSVSEHFVRSRMLPRPFWMMCTQIIMVVTFLLFATGLHSLIYVSTTLLGICYGVQFAVMIPTVSELFGLKDFGLMYNFMLLVNPLGAFFFSALLAGYIY

SEQ ID NO: 62402 - protein, 175 aa, Sorghum bicolor
  unsure (1)..(175): unsure at all Xaa locations
  Clone ID: 18060674.pep
HEADHESTESDEDFYMCQICNTEEDKSLLLYCSICASRVHPGCLTPPWTEIVTDDWSCYGCKEKVESYLKERDAYLTELSKRYDAALDRKSKILDIIRSLDLPSNPLDDIIDQLGGPDNVAEITGRRGMLIRASDGKGVIYQARNTKEVALDMINMHXKEQFMDGEKNVAIISEA

SEQ ID NO: 62403 - protein, 157 aa, Sorghum bicolor
  unsure (1)..(157): unsure at all Xaa locations
  Clone ID: 18060683.pep
MEDQSPDHISVGSAPKKSSTSSRGRHRNFSSSTCKDFLRKFVDSELLTSSLEDWFSGHSEDCGFRKPAFDVPFDLTELQNFDYALEGVTFQQLVRMPNALYASTSDVFEATAYLALEDFLHAGIKGLWQTFWGPDEXMPFSVACIHSTGSKFYPAEK

SEQ ID NO: 62404 - protein, 146 aa, Sorghum bicolor
  Clone ID: 18060691.pep
ARGNAPMDKILWDAGQHAYAHKILTGRRSQFHTIKQKNGLSGFTSRFESEYDPFGAGHGCNSLSAGLGMAVARDINGRKNRIVTVISNWTTMAGQVYEAMGHAGFLDSNMVVILNDSCHTLLPKADGRPKMSVNAFSSALSKIQSS

SEQ ID NO: 62405 - protein, 43 aa, Sorghum bicolor
  Clone ID: 18060701.pep
LHCTLAMTQDPAFPPSAMAALSTLCSAACRRRRTRPMSSEASC

SEQ ID NO: 62406 - protein, 64 aa, Sorghum bicolor
  Clone ID: 18060703.pep
LAKRECIEHFQADPYVVSKQELPEEQSNAHSILNFVAALHKGNNSSLPIGMFLENYTHIQRRIK

SEQ ID NO: 62407 - protein, 171 aa, Sorghum bicolor
  Clone ID: 18060723.pep
MSAKGDSGDKVADKPAAPLNVQISHDDASIKDNSVAKTDEIPASPADNQSILVSLSSRCVWKETLCERPHLLRIKYYGNFDKPLGRFLRDQLFDQSNLCQSCELPPEAHVYCYVHPQGSLTISVRKLSVKLPGDGENDGRIWMWHRCLRCPRVNGLPPATKRVVMSDAAWG

SEQ ID NO: 62408 - protein, 152 aa, Sorghum bicolor
  Clone ID: 18060725.pep
ARGEYNKHSGLAQEAQSIQQDLRMIGAAMDDQLRTLGRHQRPAIARVYSEEILDLAHDIEDCVDRFTHRLSCKQKRGGSGAASSLARRVAHGLRKVQSRSSYADEIQKLKRRLKEAHQRVINNSVPLPVGQPRPQPNGGSPPPSSMVQAALD

SEQ ID NO: 62409 - protein, 44 aa, Sorghum bicolor
  Clone ID: 18060779.pep
ATTVSFIMTISGEKTLAYVPCKNKTEASPLFRISITQLYRINKL

SEQ ID NO: 62410 - protein, 150 aa, Sorghum bicolor
  Clone ID: 18060808.pep
TRRHLKGERDLWERYGGVDISLDPCSFGQANTLSFNSLLHKLNKYVPRGSTVVDLYSGAGVIGLSVAASRKCRSVKCVEINKQSKMSFETSASRLPANLGCTITWHNTDASVEPVHWLEGSSVVIVDPPRKGLHPSVISALQKVALSERK

SEQ ID NO: 62411 - protein, 163 aa, Sorghum bicolor
  unsure (1)..(163): unsure at all Xaa locations
  Clone ID: 18060812.pep
TRELFNLALLAKQAWRVLQEPRSLSGXVYFPDADFLEADLGSSPSRVWRSIIDGREVLKEGLIRRIGTGQLTSIWTMNWQPSGSLRRPIRRAHPNPPQRVSELINHSEAVWKMELLNQCFTPMDARTIASIPICTRNQDDFWAWHPEKRGLFSVRSAYFMLVQ

SEQ ID NO: 62412 - protein, 141 aa, Sorghum bicolor
  Clone ID: 18060848.pep
TRIKFKEGAWVPIVLALIFILIMCIWHYGTIKKYEFDVQSKVSINWLLGLSPNLGIVRVRGIGLIHTELETGIPAIFSHFVTNLPAFHQVLIFMCIKNVPIPHVRPEERILVGRIGPKQYRIYRCIVRYGYHDFHKDDIEF

SEQ ID NO: 62413 - protein, 195 aa, Sorghum bicolor
  unsure (1)..(195): unsure at all Xaa locations
  Clone ID: 18060902.pep
HEAAVAAADAGGDAGEAAAAAVQKNGGWFGFISEALEVVLKVLKDGLSAVHVPYAYGFAIILLTIIVKAVTLPLTKQQVESTLAMQNLQPQLKAIQQRYAGNQERIQLETARLYKQAGVNPLAGCFPTLATIPVWIGLYQALSNVANEGLFTEGFFWIPSLGGPTTIAARQSGSGISWLFPXVDGHPPLGWHDTI

SEQ ID NO: 62414 - protein, 137 aa, Sorghum bicolor
  Clone ID: 18060920.pep
ARGSCQPAATDSTAPNHLLSFPILLAGSLVLATMNSYSGDRSSCCRWMGPHHEPMGVGCPRALVNVGRRCLAGGGAASSTSLPWTGSGASSDAAASRPPKAYFGSTAKALLISLQAKVLMRGGILGAFQTLWRIDLA

SEQ ID NO: 62415 - protein, 180 aa, Sorghum bicolor
  Clone ID: 18060930.pep
MSKKQDSAWFQDSKHSDRYAGRNEYAKPYHGEPGFKRRRSRSRDHDRERYGRSISPPLREERYNYRGRDFGNYPPHYSMEKSRRKYAEVDKQKLSGSGGYIGGSHQKYESRLGGYSPRKKKTSLQAEQATTKTPSKVIQSPEKKSATWDQPPVKANQSNFPTTFLPTVGQMAPIPFSFST

SEQ ID NO: 62416 - protein, 184 aa, Sorghum bicolor
  unsure (1)..(184): unsure at all Xaa locations
  Clone ID: 18060946.pep
TRKELSSKLTESFDEELITSAVGKLDKGLRDAGVSYHNLSGRHKSLYSIHSKMLKKNLTMEEIHDIHGLRLVVDTVEDCYEALCVVHKLWPRVTGRFKDYISRPKLNGYRSLHTVVMSEGVHPFEVQIRTKEMHLQAEYGFAAHWRYKEGTCRHSFVLQMVEWARWVLTWQCEAMNKERTASLX

SEQ ID NO: 62417 - protein, 177 aa, Sorghum bicolor
  Clone ID: 18060948.pep
TRGDPIINSVSSSSSPAGSSKQIEVSNSGSALSMAETVMQSPLKISTTPQLSIDAQKIEERTMRQCILRPLTPSSNKISASNSLDKLLKSKGARAGESNGPIKVAPQLSIQPSSSSVRTPAKTELVKQSQSGSLQVLSREQNGTVNTAAKDSTSNPVSPVLGRSSSMEPMRESIVNP

SEQ ID NO: 62418 - protein, 195 aa, Sorghum bicolor
  Clone ID: 18060958.pep
ARGRKVDSDCLASVPSHAQEHSQSAMPEDLGQVNCDLVGTQESSTLPPLMGESSGNLAQQEQQQHQEGVSSGSDADAASPAHTSTPEKVEPTSRRWGKKSTKGVQRLKVAKDKVMKPKVTTPSTVKKNKKMPEDGNQRVRAARSNSARRKLDLDSSESKTCFSRAELMGNLKSLAKIHGLDSEPTTRKRSKRGKK

SEQ ID NO: 62419 - protein, 205 aa, Sorghum bicolor
  unsure (1)..(205): unsure at all Xaa locations
  Clone ID: 18060975.pep
ARGEYLNGPACEAIHLTDIQSSIECDTFIPPVDFSVFQPWETSFPVVESNIRHSFVTEGRVRKSVAETHESNGKESTEVDTKNDKFEIENFSFLPEMVYDRHEEYQYLNLVEDIIRSGAQKNDRTGTGTMSKFGCQMRFNLRKNFPLLTTKRVFWRGVVEELLWFISGSTNAKVLQEKGIHIWDGNASREYLDSVGLAXREEGDL

SEQ ID NO: 62420 - protein, 187 aa, Sorghum bicolor
  unsure (1)..(187): unsure at all Xaa locations
  Clone ID: 18060976.pep
ARGVIEISDKPRQREAEPAFKFIGNVHGDEPVGREVLIHLANWLCDNYLKDSLXRGNANNIDLNRDFPDQFFSVNNDIDYRQPETRAIMNWVKQEHFTASASLHGGALVANYPWDGTRDTIKHYYGCPDDKTFRHMASVYSRSHYNMSLSKEFEGGITNGAFWYPIYGGMQDWNYIHGGCFELTLEI

SEQ ID NO: 62421 - protein, 163 aa, Sorghum bicolor
  Clone ID: 18060984.pep
MKNGTILNPASAEAGKDTRKGLTQEELARIVSHCYNDMPAEIITCSLYLGIFPKGSRISRKRLIRRWIAEGFVSEKDGMSVEDVAETYFGHLVRRKMIRPVEHSSSGRIKQCVVHDMVLEHIVSKASEENFITVVGGHWLKNTPSSKVRRLSLQGSDPKRAKD

SEQ ID NO: 62422 - protein, 163 aa, Sorghum bicolor
  unsure (1)..(163): unsure at all Xaa locations
  Clone ID: 18060991.pep
TRVLYYLSWFFSSASTPMLAKMMPFTETAISIANDTLKSALNVVKNFSSDSNNEGVIGHVIEVVTQSLKINATGLSVIQGTGKSSLMKGTTIGSSYLSDLTTLAVGYMFIFCLVFLYIGSLALLRYARGERFTIGRLYGIATILEAIPSLCRQXFAGMKHLMT

SEQ ID NO: 62423 - protein, 187 aa, Sorghum bicolor
  Clone ID: 18061001.pep
TRATRRELVDDEEDEEDEALKLGVEKNGGETGGVDGSYLSETRFDQCAISPLSLKAVKDAGYERMTEVQAATLPIILQGKDVLAKAKTGTGKTVAFLLPAIEVLSTLPRERNQLRPPINLLVMCPTRELANQVAVEARKLLRYHRSLGVQVVIGGTRLTQEQRSMQANPCQILVATPGRLKDHLENH

SEQ ID NO: 62424 - protein, 87 aa, Sorghum bicolor
  Clone ID: 18061007.pep
TRVCFFDVQDEESSSHIFDDTDASATIQTNSVSQPTSDYLSDRPLSNDENRLDRKLSKESNEKMDNRKLQPESNLSDGARPLISEGE

SEQ ID NO: 62425 - protein, 62 aa, Sorghum bicolor
  Clone ID: 18061017.pep
MVRVNSSSSAPGVNLTEQTENVFEQLISKIEPADFDPRPFLKQLNVLGRYEPIKRNVYCTKR

SEQ ID NO: 62426 - protein, 169 aa, Sorghum bicolor
  Clone ID: 18061055.pep
HEGSFGELFLAVNVQTGEEVAVKLENVKTKHPQLHYESKLYMLLQGGTGIPHLKWFGVEGEYNVMVIDLLGPSLEDLFNYCSRKFSLKTVLMLADQMINRVEYMHQKGFLHRDIKPDNFLMGLGRKANQVYIIDYGLAKKYRDLQTHKHIPYRENKNLTGTARYASVNT

SEQ ID NO: 62427 - protein, 171 aa, Sorghum bicolor
  Clone ID: 18061095.pep
TRVICTYPLDLVRTKLAYQVKGAVNVGFRESKPSEQVYKGIMDCVKTIYRQNGLKGIYRGMAPSLYGIFPYSGLKFYFYEKMKSHVPEEHRKDIIAKLGCGSVAGLLGQTITYPLDVVRRQMQVQALSSSSLVGRGTFESLVMIAKQQGWRQLFSGLSINYLKVRYFLKFI

SEQ ID NO: 62428 - protein, 191 aa, Sorghum bicolor
  unsure (1)..(191): unsure at all Xaa locations
  Clone ID: 18061123.pep
TRERHEVSLIPSAQDTVQEKIVILSSSETVEGSLDAVQEKLVILSSSETVESSYAVSCIVDDTVHDAYDISQADSVQHEEHSGISDGSTEKLVSEESSLVYCGAPSNKKDLVNVSVQECEAFILENPAPQILEENGPDMDVSTDSVSLSHADAAHDLACQHVSSSVVETPSYEPDIGPEDVTXNSIVENEA

SEQ ID NO: 62429 - protein, 198 aa, Sorghum bicolor
  unsure (1)..(198): unsure at all Xaa locations
  Clone ID: 18061137.pep
ARGCTQQRMVLRGQGDSPVRICDPCKKLEEAARHELRYGHKNRATRATKSGSKPEDDILSEILGGGEHIQSLDSELPGRTTSNASTSRRTSSNFSADSNGDESLSAEAHNYELNNTASIFTPEELRQQAVEEKKRYKTLKSEGKPEEALRAFKHGKELERQAAALELELRRSRRMATXAPNVSAAVGTSTTAGSDEAE

SEQ ID NO: 62430 - protein, 87 aa, Sorghum bicolor
  Clone ID: 18061142.pep
PSSAGTRYGCTSLALRFGHFLLECVYLFLLITQCHLLPLRLVEFFNTNVHPNTSNKSTIIEMDDETLPIWPFYHCPNCEMDISSQSI

SEQ ID NO: 62431 - protein, 65 aa, Sorghum bicolor
  Clone ID: 18061174.pep
DLKISSHLVLHVPWQEKIIIISLFSTTTVDVQTTNTKHVLAKARRLNTDYVHYQLVNSRWTPSAN

SEQ ID NO: 62432 - protein, 134 aa, Sorghum bicolor
  Clone ID: 18061213.pep
MPQLRRLCLDLDARDEMPELESLEFGIQHLTCLVQVRATIHCKDTLTASEVEAAEAHIRGQVSLNPNNRVFELNRRVQRSAAKAAEAPVIAIQSLDEWSSQVCPDKLVVVFFTASWCRPSHRMDPVFADLAKKN

SEQ ID NO: 62433 - protein, 171 aa, Sorghum bicolor
  Clone ID: 18061215.pep
ARGGRLQIDKSMMDELKEVKKAVNPTEVLLVVDAMTGQEAAALVTTFNIEIGITGAILTKLDGDSRGGAALSVKEVSGKPIKFVGRGERLEDLELFYPDRMAQRVLGMGDVLSFVEKTQEVMRQEEAVELQKKIMSAKFDFNDFLKQSQNVAKMGSMSRIIGMMPGMNKIT

SEQ ID NO: 62434 - protein, 207 aa, Sorghum bicolor
  unsure (1)..(207): unsure at all Xaa locations
  Clone ID: 18061288.pep
ARGLLSGGDGCDYYMRKXWEHQQKHIGQQRHDSAKSKTSSDKLTAENRGKILGERPLDRTTKLHSPSLSAKDAVQLQSNLIDTFVKPISLDGLPESEKPFSNDLAKQVRFEQFLRDKYKGGLRAANVTPTSTMSEADRARERLDFEAAAEAIEKGKGKKVIDPSSVFSLPGMNEQRFVAATQPESSVVIQDEKPIYPQREQFEWRPS

SEQ ID NO: 62435 - protein, 56 aa, Sorghum bicolor
  Clone ID: 18061291.pep
PNFYCLHLFNCATIIIFCNLCAELNNHAIYLHFARSVCSLILHTLKKNSLQVSLYA

SEQ ID NO: 62436 - protein, 58 aa, Sorghum bicolor
  Clone ID: 18061298.pep
FACSALSPSKRIHVCFYCFGLNRTLFGVICDLIFGVPLIMHFDAGVTDSHWLVLITHF

SEQ ID NO: 62437 - protein, 60 aa, Sorghum bicolor
  Clone ID: 18061321.pep
QQTFTSVLLLLSIYDQHSALLMTRVKLAPRCVVVAKHHVFINSQNLLGLIYVHQTLDRGD

SEQ ID NO: 62438 - protein, 149 aa, Sorghum bicolor
  Clone ID: 18061404.pep
MAPLLTSVHCSSSYPHPSPRRITPSPVSATTPPVLRRTRTRTRRQLQRCFCSQYAGKRQPPPEPDSPQQMERLFSNLNKATMKHEPGSVTSAIFLVAGTTVGAGILAIPAVTQEAGFLASAVICILCWLYMVVTGLLVAEVNVNTMCEL

SEQ ID NO: 62439 - protein, 199 aa, Sorghum bicolor
  Clone ID: 18061414.pep
TRGNSGSGTSSSCGCMETFSLTSPRDWGLSDLTGGCARRTPLDCKGSTNRSSSSSGSTDVFHPIAQVALPYNPRGIEGAAAQSDCAEACLGDCNCTAYSYSNNGKCSVWHGDLLSVNKADNNSISSQDVLYLRLAKSDFQSLNKTNKKTPAVAIAASAVGSGLLVLMLVFLIWRNRFRWCNAHSIQDGGGGIIAFKYTD

SEQ ID NO: 62440 - protein, 55 aa, Sorghum bicolor
  Clone ID: 18061426.pep
LKLHFLFEKRKLIIYSNVCSHTLLRAIRISTQIPGTIYRLQYLNLNLIVNIGLCN

SEQ ID NO: 62441 - protein, 178 aa, Sorghum bicolor
  Clone ID: 18061447.pep
SQSILTCVRANSRYWCSFGPENYGEGGTILPSRKYRLNTRNRAARPQSMRGCTCHFTVKRLYARPSLLLIIYHERRHVNKSGFICHGPLDRDAIGPGARKMPYIGSEIQQQTMSLIYLGVPEENILQTHIEGIQRYCSADAQVDNLASQYVQKLGMIIKRSTHELDLDDQASIRMWVD

SEQ ID NO: 62442 - protein, 192 aa, Sorghum bicolor
  Clone ID: 18061463.pep
HEGSLQATEIGRAVNRLRKHNSQEIRHLVRTLIEGWKVLVDEWVSTTNAALAENSPGSSNPSVVDEEEEEGLPSPPLDEGAFFATQTTSIQLSEFFDEMDEDGNLRHNNDMSLGSKRGNNGGRLANHSAVARQEPPRSSPGVVEKVQSRRPELARQEPPMRQAIPQNPPSSSMHAKPHDVLNKQSNPSSYES

SEQ ID NO: 62443 - protein, 106 aa, Sorghum bicolor
  Clone ID: 18061473.pep
PARLAGGATPYLHAAEGARPCKLMLSEREESPFVRFGTERGMAGGGAVREVVKGVDNSQLGFAIGAGRWVRRWEGAALGRAAGAGPRGDMEMAEGRGTAGQQWGLV

SEQ ID NO: 62444 - protein, 67 aa, Sorghum bicolor
  Clone ID: 18061489.pep
YRTYPVGVTFRSILKSTIEASEATSIEDTRQKELLVHLTFPKRGFPLLILFSLCEPSLFLVRMRSSC

SEQ ID NO: 62445 - protein, 41 aa, Sorghum bicolor
  Clone ID: 18061535.pep
ICTGVSEDAVSGHIQLLVPGETACFACAPPLVCFAWFLVLV

SEQ ID NO: 62446 - protein, 187 aa, Sorghum bicolor
  Clone ID: 18061564.pep
ARGLVGLKYTPLFDFFIELQETAFRVIADNYVMDDSGTGVGDCAPAFGEDDHRVCLAGGIIETAGLVVAVDDDGCFIEKISDFKGRYVKEADKDIISAVKDKGRLVSKGSIEHSYPFCWRSGTPLIYRAVPSWFVKVEKIKDQLLECNKETYWVPDFVKEKRFHNWLEGARDWAVSRTRFWGTPLPL

SEQ ID NO: 62447 - protein, 185 aa, Sorghum bicolor
  Clone ID: 18061566.pep
MQKRRLQDSVRTDDASETISGRSSPRSESSTTELMVGQSAVSSVEGNHGCQGLCNSRTHLAQMLRVVNDAYKVQVAADVLLAAGYPISDLETFIYSATPVIGRAPCMISSTCSWDQVVSNSVCQHDISNVSLRRIWEWYEEPGCYGLEVKALSNLSSKTSCNSSSEFFAYFVPYLSAIQLFGWSR

SEQ ID NO: 62448 - protein, 144 aa, Sorghum bicolor
  Clone ID: 18061597.pep
PNTAYITLLPKRDETRSVKDFGPISLVHSFAKLITKILANRLASHLDQMVSSSLSAFIKKRFIQDNFMLVQQMARLLHQQKQPQILLKLDIMKPFDSVSWPFLLEVLRKMGFGVIWCDIISGLLASSSTQVLLNGVPVEVISHR

SEQ ID NO: 62449 - protein, 210 aa, Sorghum bicolor
  Clone ID: 18061601.pep
TRAILGILRYSAVKEAFHIAPSHFKTTLTFSLAEKLPKGDMVLEALYNNYFQLLDSSLRHLAIDSAVDKMSENHSVPFSLYALSRMGFLLLKTKDETEKEMSFCAVCFGVTKYLQAALKESICYSERIESARATVDQVKVEGIDVNLALMQELLFPFIQVGKIVYSLSQWEDPFKSLLFLAFMLYVIQRGLVSYIVPFVFLTFAIIMIWH

SEQ ID NO: 62450 - protein, 205 aa, Sorghum bicolor
  unsure (1)..(205): unsure at all Xaa locations
  Clone ID: 18061605.pep
TRIFKADGNPTCLRSRWQLEAYLNQQADILEKDPGSVPLNSFNATMTQLQTLAPELHRVQFLQYLNALCHDDYVASLDNLHRYFDYSAGMQGLFGRSVAQVQDIVVGKYESALLCLGNLHCYFGHPKKALEAFAEAVRVSQMNNDDSCLAYVLGAISNLLSKIGISXTVGIITSPYSLGTNIGLGTPLSIQQQLLVLLKRSLKRA

SEQ ID NO: 62451 - protein, 204 aa, Sorghum bicolor
  Clone ID: 18061623.pep
HEADIYAEVPGRREGYVMKLLSVDPSNYDDAPIEGIRRILEEFSGERIPRSAKIPTGKIEWIRMGTTVATNALLERKGERIALCVTRGFRDLLQIGNQARPNIFDLKVSKPSNLYEEVVEIDERVELVRDGDSDRDGSSVEGISGELVRVAKPVDVEALKPLLKGLLDKGIRCLAVVLMHSYTYPHHELLVEKLALGMGFKHVS

SEQ ID NO: 62452 - protein, 172 aa, Sorghum bicolor
  Clone ID: 18061631.pep
ARGSVMRAVEGAEATMRSQMEENNRLKEELMRKTQQLQRMREDATSQSPLSGLDQERNSVSNKMDGSNSSVNPQSSLIHRQNGSFESREPLTQESLKQKYIDSPQANGAFKRSLGEQTAVDSGGPSQFSTPSSRSLSPNRHKKDGEYDSRLLPVSEMNSNISWKQDLTVKVK

SEQ ID NO: 62453 - protein, 92 aa, Sorghum bicolor
  Clone ID: 18061635.pep
TRVLIPIGRLGVILLLLELISEMLHSSSMKVPIFVISETAEEIFAFTNALPEWLCKSRQEKLFAGEALFGHVELLKEGKLFLFPHLHSKGLL

SEQ ID NO: 62454 - protein, 79 aa, Sorghum bicolor
  Clone ID: 18061639.pep
PLLLHVLDFSTASSPPPIHAVVPPSSCKYVLFSPSPLLPLLFLPCFVCSASCDHAKIVRTWISVLLCGLVDACARLLCG

SEQ ID NO: 62455 - protein, 190 aa, Sorghum bicolor
  Clone ID: 18061647.pep
HEALLQPRTGLLPISVRAVYIHAVFKVITWCFSVYVGRLGDSGMAMDVTFDRSAADQTVSLDSNVALGSGEEQGIGASTVRKDPFSHESILYMIDLIQTTVGPLINCNEVEVQDRAHNLIGFVHLVREIQELNKTKVADGDKPSRLEELVKTMRTVFCQELGPVSVNAQMKVALPDGLILNENLVELAGM

SEQ ID NO: 62456 - protein, 182 aa, Sorghum bicolor
  Clone ID: 18061662.pep
HEAFYNKLIDSLLLKGIEPFVTLAHYDIPQELVDRYGAWLSTEVQRDFGYLADVCFAAFGDRVKHWATFNEPNVAMTKGYMLGTYPPGRCSPPFGSCAQGNSDAEPYVATHNVVLSHATAVEIYKRKYQRKQKGMIGIVMAAFWFVPLTDTPVDRMATERALAFSVPWYLDPIVYGDYPPEM

SEQ ID NO: 62457 - protein, 142 aa, Sorghum bicolor
  Clone ID: 18061666.pep
ARGSRQVVLRQCCQVWMVLNGKHISTSNDHLEHSENIGYGGSSGILASIHELGEESDGYVTPPTDLVDEIIDEESTEMNDSDQLVTEDETLTEQGTEESVTSEEMEDFFEGGADQSDEIQSFRNITEKAEKIMVVSTCNRRK

SEQ ID NO: 62458 - protein, 187 aa, Sorghum bicolor
  unsure (1)..(187): unsure at all Xaa locations
  Clone ID: 18061682.pep
TRKCSRCKRVRYCSQECQTNHWQSDHKFKCKQMKSLDPADKLSSGGEANNKKTSGFGRISLVPACKKISKGQVLFPYDEFLKLYNWKEFDFVPCGLMNCGNSCFANVVLQCLSCTRPLVSYLLGKDHSRECSMRHEDWCFLCELQCHIHRASGSLHPFAPTNILSHLPNIGGNLGFGXQEDAHEFMR

SEQ ID NO: 62459 - protein, 204 aa, Sorghum bicolor
  Clone ID: 18061696.pep
ARGQEQMVRGAASFALGQFAEHLQPEILSHYASVLPCILNALEDPSDEVKEKSYYALAAFCEDMGEDILPYLEPLICRLVMSLQSSPRNLQETCMSAIGSVAAAAEQAFTPYAEKVLEMMKGFMVLINDEDLCARARATEVVGIVAMAVGKARIEAILPPFIEAAISGFGLDYSELREYTHGFFSNVAEILGESFTQYLPHVVP

SEQ ID NO: 62460 - protein, 152 aa, Sorghum bicolor
  Clone ID: 18061713.pep
MAKAVLHNQSCCSAISGMSSRGAKDRSFGLVGDGEELGRRGEASTFQESSRSLLQKYRPKSFSELVGHGVIAQSLSGAVLKGKLAPIYLFHGPHGVGKTSMARTFAAALNCRSPGGNQPCGRCDERVAIFSGSSSSVVEIDASKLDCKSRVA

SEQ ID NO: 62461 - protein, 185 aa, Sorghum bicolor
  Clone ID: 18061717.pep
ARGSLSEQLREAGIPHEVLNAKPENVEREAEIVAQSGRLGAVTIATNMAGRGTDIILGGNAEFMARLKLREILMPRVVNPIDGVIVSKKQMPPRKTWKTNESLFPCELSKETLSSVKDTVEMAVKEWGEKSLTELEAEERLSYSCEKGPTRDEVIANLRNAFMKIADEYKVFTEEEKKKVITAGG

SEQ ID NO: 62462 - protein, 177 aa, Sorghum bicolor
  unsure (1)..(177): unsure at all Xaa locations
  Clone ID: 18061723.pep
TRIRQGPLILFLKDTEKXCGNNDSYHGLKSKLKHFPAGAFIIGSQIQPDNRKEKANGSSPFLSKFPYSQAILDLALQDIDGGNDNNKETSKAMKHLIKLFPNKVTLEAPQDETELSRWNQMLNRDIEVLKGNANISKLRSFLTRVGLECTDLEAILVKDRILTNECIDXIIGFALSH

SEQ ID NO: 62463 - protein, 183 aa, Sorghum bicolor
  unsure (1)..(183): unsure at all Xaa locations
  Clone ID: 18061763.pep
HEASLSLGLGLGDGGAALLVVSGKKLFVVLVALVILPTTWLRSLGVLAYVSASGVLASAVVVVCVLWTAVADGVGFHARGRMLNVSGLPTALGLYTFCYCGHAIFPTLCNSMKEKKRFSRVLVICFVLCTLNYGSMAILGYLMYGDDVKSQVTLNLPEGKIGSKLAIYTTLINPFSXYALMVT

SEQ ID NO: 62464 - protein, 125 aa, Sorghum bicolor
  unsure (1)..(125): unsure at all Xaa locations
  Clone ID: 18061771.pep
ADDGDTALFLAHGLLELDVDHTRFYSKANIDINGPRARVFLNTSGEDMLNGGYIDSGTIHHMTRHRELFSNLDTSVHGLVQSSNAPGXEIQGVGLIMSQAKNSEHHVLHCVYFKPXVHNSIMSLG

SEQ ID NO: 62465 - protein, 123 aa, Sorghum bicolor
  Clone ID: 18061779.pep
KGHLLVQQPQSVATDTRLEMADNVANCYLEFTGSLDGQSCLIGASVSHDEAMAAKVLQTAQPDIVTDCTFGVGTSNHAGCSDMQLPVTQTTSVQEPGLSLSKDLNSSCGLSLSKDLNSSCIQG

SEQ ID NO: 62466 - protein, 171 aa, Sorghum bicolor
  Clone ID: 18061817.pep
ARGFVTISHYDIPQELEMRYGGWLSPEIQKDFGYFAEVCFKMFGDRVKFWITFNQANLSLKFSYMDGWYPPSRCSQPFGNCGFGNSTTEPYIAGHNMILSHANAVSVYRKRYQEKQGGHIGISICAIWYEPFGNTTADILAVERALSFGGPWFLDPLILGDYPIEMRKILG

SEQ ID NO: 62467 - protein, 118 aa, Sorghum bicolor
  Clone ID: 18061847.pep
SKVTESASDGDDDVAGAHQEDDVVISAAAQVVPPQKAVGGKRTTTDAPEASRKAPRLASTSSPPVQEPRQGTLDTVVGMLNRQMSRSDHLENELEMARQEAHRQGGAVELQARHSERI

SEQ ID NO: 62468 - protein, 190 aa, Sorghum bicolor
  Clone ID: 18061864.pep
ARGVSPRGRKALPNPNRPSLVPAPDPLPAPRRPRSPRSSAHRPATLRARLRWTVDGARPRRLRCAARRARPADSGSQQQQLLLHHTMFPCRGVATANPHLPGALAANRYGSPTRPSFYPSAAFLRLQGPAFRHEKKSLALRAGADFHRYAIPPSFAKYNPVKGIKPLLSSPKLKSRTQVGCQASLSSFSY

SEQ ID NO: 62469 - protein, 203 aa, Sorghum bicolor
  Clone ID: 18061938.pep
TRQLLQQQSNSQQLQQHQLQQPAVSSQQSQSSNQHLQQEKPGIGSMPVDGGIPNSFGGAEQTAKKRKKPGSSSGRANSSGTANTAGPSPSSAPSTPSTHTPGDAMSVPQLQQNGGSAKPMVIFGSDGTGSLTSPANPLDDVDRLLEDGSLDDNVESFLSQDDMDPRDNLGRCMDASKGFGFSEVAKARASATKVVCCHFSADG

SEQ ID NO: 62470 - protein, 175 aa, Sorghum bicolor
  Clone ID: 18061951.pep
TRQQQSSFIPVQPRQVSSSAGSHSRPHVPTVTQFSQNLHRPSSNVSFGSRIGNSSTSSGSTMPIPASQDPSTSLLGSDYPEPLLLGSSLFTADSTNFLSASGSRSNQQNSGSSSSSMLRPADNVGAPQVAGFNASQPSTTIRGSSDVSRRSLISAGASHSRSSSIALQQRGTSST

SEQ ID NO: 62471 - protein, 167 aa, Sorghum bicolor
  Clone ID: 18061985.pep
ARGFDWGSRACVELYHKGTIIEIYRMSRKKMQRPWRIDDFDMFKKRMLTDRKDQPYKRALLFVDNSGADVVLGMLPLARELLRRGTEVVLVANSLPALNDVTANELPEIIAEASKHCSILRKAAEAGGLIVDAMAGIQDDLKDEPVSVPLMVVENGCGSPCIDFRQV

SEQ ID NO: 62472 - protein, 60 aa, Sorghum bicolor
  unsure (1)..(60): unsure at all Xaa locations
  Clone ID: 18061992.pep
TRPHMAREYGFEYELITYKWPTWLHKRKEKPRIIXAYKILFLDVIFPLSLRKVIFVDADQ

SEQ ID NO: 62473 - protein, 140 aa, Sorghum bicolor
  Clone ID: 18061998.pep
HEENLWDILDSCKKKLPLQHLQNKKVCVDLSCWLVQFCSANRSPDFLRDKVYLKNLFHRIRALLALNCSLIFVSDGAIPSVKLATYRRRLGLNAAEATLEEANSQPLTSLRRNKSSEFSRMIKEAKHLGLALGIPCLDGV

SEQ ID NO: 62474 - protein, 42 aa, Sorghum bicolor
  Clone ID: 18062011.pep
TRHNLYRPLVNSGLAFGAKRWVGTLDRPCKRLANAMASNIPN

SEQ ID NO: 62475 - protein, 206 aa, Sorghum bicolor
  Clone ID: 18062038.pep
ARGFGWAGIFRRYLVEPAAMWWPSNLVQVSLFRALHEKERRRKGRMTRNQFFLVAFICSFAYYIFPGYLFQMLTSLSWICWVFPISVIAQQLGSGLHGLGIGAIGLDWSSISSYLGSPLASPWFATANIAAGFFIVMYIITPINYWFNVYKARNFPIYSDGLYTESGQKYNVSSIMDSQFYFDTDAYEKNGPLYISTFFASSYGLG

SEQ ID NO: 62476 - protein, 170 aa, Sorghum bicolor
  Clone ID: 18062060.pep
TRISLVEVSQSGSTSSLDATGSTGGYSLVEGSLPEASCGAQRCEPEVHEVPTGSPATVGFPSEDGGSGFGIELNDDVDGRNGLAGGELELSTDGDDAEDITEIAGILCGERVEGMETNSGQHEASNGSTVPSEEGVDRMETSLDDSEASDGSTTQDSDTDVETESSVSSI

SEQ ID NO: 62477 - protein, 49 aa, Sorghum bicolor
  Clone ID: 18062068.pep
MRRILVCNPITNDWKRLLDAPGGKTSDYSALAFSVDRSSHHYTVAVAKS

SEQ ID NO: 62478 - protein, 185 aa, Sorghum bicolor
  unsure (1)..(185): unsure at all Xaa locations
  Clone ID: 18062088.pep
TREAAKCLDTMTSKGLLPNAFTYNTVMTAYGNIGKVDEALALFDQMKKSGCVPNVNTYNFILGMLGKKSRFTVMLEMLGEMSRSGCTPNRVTWNTMLAVCGKRGMEDYVTRVLEGMKSCGVELSRDTYNTLIAAYGRCGSRTNAFKMYNEMTSAGFAPCLTTYNALLNVLSRXGDWSTAQSIVSK

SEQ ID NO: 62479 - protein, 122 aa, Sorghum bicolor
  Clone ID: 18062095.pep
RRRILASPLFLVLSLRPRLLHSTPAHPTFASTQRIFSLFKYYIYTTRSLIGSSGQDCPKLVRVYGGRFAGKLARLAEMEVKYRCNQILEIGLPMGGLAKLFAQDWEGDVTMVMPATVAQYLK

SEQ ID NO: 62480 - protein, 203 aa, Sorghum bicolor
  Clone ID: 18062108.pep
TRLQSHIPQPGDGSAESLESSQSKFESTVPTASSGKSDQVSNWNSESNAVDPKRGDHEASVPSHSGWLSSLEMGKDTANTTNRQQHIPESVNQDAEEVLYTGRPNSSMGQSLRDLENDRADFQLAPHDPHSVVGQANLPQHDIPRESDLSPLGLLWSELEGHPKQPLSSNVLGVNERRNPKPTAPKDIPPVNMRHGPLSRMNE

SEQ ID NO: 62481 - protein, 170 aa, Sorghum bicolor
  Clone ID: 18062141.pep
TRHTAAVTLRTADPAAAAVALDAARRCISWIDVGLVANDVFVPLLFDIAMSPGSAPPLAAAAVACLSAVALKRMDSRAKVGLLRSLLAAQQGLGSPDSGLKMAPLVTAYAAEALECHRRLGPSDADGAAALEMLEEVLPAVFAAAESGNDEDVDSGSVLEFLSGYVSIMK

SEQ ID NO: 62482 - protein, 144 aa, Sorghum bicolor
  Clone ID: 18062143.pep
LNRPPPSPLRRERERFMRGSRMNPGDRRTRSTMTIVIVMGLSCFFYILGAWQKSGTGRGDSIALRVNQETDCTILPNLHFETHHTISGTNPLIMSNKMIEPCHIRYSDYTPCQDQDRAMTFPRENMTYRERHCPVENEKLHCLI

SEQ ID NO: 62483 - protein, 209 aa, Sorghum bicolor
  Clone ID: 18062152.pep
TRGRRYPVEIHYTKAPEADYIDAAIVTVLQIHVTQPPGDILVFLTGQEEIETVDEILKHRTRGLGTKISELIICPIYANLPTELQAKIFEPTPEGARKVVLATNIAETSLTIDGIKYVIDPGFCKIKSYNPRTGMESLLINPISKASANQRAGRSGCTGPGKCFRLYTSYNYMHDLEDNTVPEIQRTNLANVVLTLKSLGIHDLVNFDF

SEQ ID NO: 62484 - protein, 155 aa, Sorghum bicolor
  Clone ID: 18062182.pep
HEAQIEEFFNRFGAGEAAAMCLMLAAKLLYAEDSLISNAVSEKAAEAFEDPGLVGMPQIDGTTALSNTRTQAGGFSMGQVVQEAEPLFSGAYEGLCLCSSRLLYPIWELPVMVIRGPAGTNKREDGVIVCRLSAGAMKILESKIHSLETFLRSRR

SEQ ID NO: 62485 - protein, 206 aa, Sorghum bicolor
  Clone ID: 18062195.pep
FGKRELVAYKNVNDVPFVRDLVIQVDQKNEAVLLPIYGSMVPFHVSTVKSVTSHQDNRTCTIRIFFNVPGMPFSNDSKLNSQGAIYLKEITFRSKDPRHSSEVVQQIKTLRRQVASRESERAERATLVTQEKLQIGNNRMKMMRLSDVWIRPAFGGRGRKLTGNLEAHFNGFRYSTSRSDERVDIMFGNIKHAFFQPAEKEMITLL

SEQ ID NO: 62486 - protein, 206 aa, Sorghum bicolor
  Clone ID: 18062201.pep
HEARQALEEYDDSLQKLEENNTKQNDDSIKVSGKRTFGPVKNTHEEVKKRKLQDTENSSDSEYDSEPAQHLSNNEVTMKHDDIQFGNALLDDEPQNDMYRSFNDIIKNPGPKTTFEVGMLAGDSWKKVKSNKGNDQSNGNGITNKSKLPVPSIVDPKPKQQDHSSDSDSEEEMVEGFLTVSDRKENYELPSQEDLIRQAFAGDDVE

SEQ ID NO: 62487 - protein, 177 aa, Sorghum bicolor
  unsure (1)..(177): unsure at all Xaa locations
  Clone ID: 18062221.pep
TRVKRSSSKKSQVLKKQQPLPQGFFPPMADPNFTDQDPNYSSPFGAFFAQFAYKPDRRKDGSGLPLPNTADRPARLPPRGHPSSRSSLLTAKESSKAARTTTSNTMQPCPASASTSGSQEGIRVKGIEKPEKMMTMEKKPRRKSPLLSAAEKRSDKYRRLPLDQLVPPPCSPHKLLX

SEQ ID NO: 62488 - protein, 63 aa, Sorghum bicolor
  Clone ID: 18062225.pep
ESYEMSSLIHYIDFSSSKMKGSKRSLSDIILATCIVISDITLQKRYYEQLELESLQNIAIPLV

SEQ ID NO: 62489 - protein, 169 aa, Sorghum bicolor
  Clone ID: 18062227.pep
MFSDIKNTDQRSFKCPSHPLSEEHLQLLVKALPIEEGDYLRIIWPIIPSIQFYKEGPCRYLSHLIGHEGEGSIFHIIKELGWAMNLMAGESTDSNEYSFFSVSMRLTDAGHEHMEDIVGLIFKYLHLLKEDGVHEWIFNELVAINEMEFHYQDKVHPINYVMHTVSTMR

SEQ ID NO: 62490 - protein, 92 aa, Sorghum bicolor
  unsure (1)..(92): unsure at all Xaa locations
  Clone ID: 18062244.pep
RNLSRRRRGXXWGFWTPYAQCATVLMKIVAAISQVQNGKASVWRRLGLEERKILLTRSSGPEVIERILPFNEESKLTIILLLCFYGVAGMLG

SEQ ID NO: 62491 - protein, 146 aa, Sorghum bicolor
  Clone ID: 18062246.pep
ARGNSLSITIQQTCYTLRVVSLKELVDEGSIETSALTPPEYAKTMHENLDEVCSGIDAPARTASLETSEEVSSWIASLVCAQNKGVKEMDGDLPFGFSKQEDEGFSVTAGWHTTPVIGPEGSIFSGIKQHEDYKVKEVTCLRDPSS

SEQ ID NO: 62492 - protein, 28 aa, Sorghum bicolor
  Clone ID: 18062281.pep
GRSLLSSSGAVNKPTHDSLSMPITYWNK

SEQ ID NO: 62493 - protein, 170 aa, Sorghum bicolor
  Clone ID: 18062302.pep
ARGRRVLVQILFGLVFAFSCNLFELVLFEILPVLSKHARFLNWHLDLFCLILLLVFVLPYYHCYLLLRNSGVRRERAWLVAALFLLVFLYGFWRMGIHFPMPSPEKGFFTMPQLVSRIGVIGVSVMAVLSGFGAVNLPYSYLSLFIREIDEADIKTLERQLMQSMETCTS

SEQ ID NO: 62494 - protein, 168 aa, Sorghum bicolor
  Clone ID: 18062314.pep
TRPMWKGVVVAYIVVAVCYFPASLVGYWAFGNSVNENILVTLNKPKWLIALANMMVVVHLIGSYQVYAMPVFDMIETVLVRKFGFRPSLMLRLIARSVYVGFTMFVAITFPFFTALLSFFGGFAFAPTTYFLPCIMWLTIYKPKTFSISWFTNWICIVLGVLLMVLSP

SEQ ID NO: 62495 - protein, 201 aa, Sorghum bicolor
  Clone ID: 18062320.pep
HEAYNSGLRYFTVHACPLEKRSSGLSCFMNPRRTQKDLKFVSTSPHEAFRWVNSFADQQCYINLLPHPMASSKKHSSELIQFDTMFDPYLKKCRSPPKILVILNPRSGHGRSSKVFHGKVEPIFKLAGFKMEVVKTTHAGHAKSLVSTIDFSTCPDGIVCVGGDGIVNEVLNGLLCRDDQNMAASVPIGIIPAGSDNSLIW

SEQ ID NO: 62496 - protein, 170 aa, Sorghum bicolor
  unsure (1)..(170): unsure at all Xaa locations
  Clone ID: 18062328.pep
HEADSLKDEFDMLSEDFSECFNDFSMPGFIRKTKELWVDKYTPHSLAELAVHKKKIEDVKKWLEEKLKAPKTTVGGWTLVLTGQTGVGKSATVKAIADDLGADLCEWTTPVPTLWAEHVHANSGLRYISXLEEFETFVEKIRKYSMLCPTNTKSQRKLIIILIDDIPVTS

SEQ ID NO: 62497 - protein, 70 aa, Sorghum bicolor
  unsure (1)..(70): unsure at all Xaa locations
  Clone ID: 18062344.pep
LQHVTDLGFKWRTEEIEQMYLDXEIYVIWDWEAALARLTDQAVTWVSNDTIVSSEEFSYSYFTHVIRVIY

SEQ ID NO: 62498 - protein, 40 aa, Sorghum bicolor
  Clone ID: 18062346.pep
FPGCLLAVSSLDILWILPILGSLSIPPPSSNLYPLPFYLE

SEQ ID NO: 62499 - protein, 65 aa, Sorghum bicolor
  Clone ID: 18062351.pep
RGHKGLYDTINNSIHFQLGLALASLGVITSLVAQHMYSLPAYAFIAQDFTTQAALYTHHQYIARF

SEQ ID NO: 62500 - protein, 198 aa, Sorghum bicolor
  Clone ID: 18062361.pep
TREEREKGGGGGAAPQRKQRGRSDALVGSGELLAIPGVGPRNLRKLVDKGFDDVAQLKQFYRDKFFGKSNEKMVEFLQNSVGIIHKNHAESITLFIKESVDEELKGTDTSNLPKNRRLTFCVEGNISVGKTTFLQRIASETIELRDLVEIVPEPIAKWQDVGPEHFNILDAFYAEPQRYAYTFQNYVFVTRVMQEKES

SEQ ID NO: 62501 - protein, 181 aa, Sorghum bicolor
  Clone ID: 18062365.pep
TRGTRAGKAVHMLIHHSRNTAQKQWDETIVLVLGGIARLLRSFFSYLQQLRKFSSGWVLLLDFIKNSILNGSKEVALAAINCLQTFVVSNCPKGNLESPYVKSVLDIYELVLQTSPNFKNDSTDKVKQEVLRGLGDLYVQARSLFNGDMYLRLMAIMHLMIKTTLNPTDYDSELGSIPAVH

SEQ ID NO: 62502 - protein, 179 aa, Sorghum bicolor
  Clone ID: 18062384.pep
TRVVRAPARLGKRGLCAGAEAGGSAGTVVGQEEALEWVKKDRRRLLHVVYRVGDLDKTIKFYTECLGMKLLRKRDIPEERYTNAFLGYGPEDSHFVVELTYNYGVESYDIGTAFGHLGIAVDDVAKTVELIKAKGGTVTREPGPVKGGKSVIAFIEDPDGYKFELIERGPTPEPLCQVM

SEQ ID NO: 62503 - protein, 167 aa, Sorghum bicolor
  Clone ID: 18062426.pep
TRLIAGLCHVRRPDLALQVLDEMPNLCLAPERDAYRTIVPALCDAGMLDEATHVVYSMLWRVSQRGCDADVVVYRALLVALCAAGRGEQAELVLDKVLRKGLRSPGSRRSLRVLMLAVLNLEDARESIDQALAVRGGRTVCSFESMIIDLYEECRFDQADKLLEDMA

SEQ ID NO: 62504 - protein, 126 aa, Sorghum bicolor
  Clone ID: 18062438.pep
MVVDDPKDENEKEKHAELLALPPHGAEVYVGGLSSDVSSEDLKRLFESVGEVVEVRMRGKGDNKAYAFINFRTKEMALKAIRKLCNKDLKGKKIKVSSSQAKNRLFIGNVPRDWTPDDFKTAVEEV

SEQ ID NO: 62505 - protein, 187 aa, Sorghum bicolor
  Clone ID: 18062479.pep
TRDQYQAVVAAAAASQSGGYLKQQFLHLQQPMQSPQEQCNLNPLLQQQILQQASQQQMVSPDAQNIQSVLSPNAIQQQLHQLQQMQHAHNDQKQKIQPDQPYQVPSSAVLPSPTSLPSHLREKFGFSDPNVNSSSFISSSSNENMLESNFLQGSSKSVDLSRFNQPVVSEQQQQQQQQAWKQKFMGS

SEQ ID NO: 62506 - protein, 171 aa, Sorghum bicolor
  Clone ID: 18062520.pep
TRALHVCFLLLDITLALQDATKAVDIIQYLERSFGVANTMNPNENASIPQQQLAQPKPPARINMPPDSDSNAYAGGYENLSAGIFPDDQIEFESLYSTFDGHQNLGRRILNDFSRASADLAATAADLKVRLQIYKVRLLLLTRNLKVAKRELKVLMNMARGRDSSTELLLK

SEQ ID NO: 62507 - protein, 164 aa, Sorghum bicolor
  Clone ID: 18062550.pep
HEEMEVLPRLLKFLDSIEEFYDCIGGIIGYQIMVLELLSSSKDHMHRPSKDKFVDFHVPSGLNLLEDKEYASQAALWGIEGLPELGEIYPIGGAGDRLGLVDSDTGESLPAALLPYCGRSLLEGLIRDLQAREFLHFKIFGGQCITPVAIMTSSVKDNHEHITA

SEQ ID NO: 62508 - protein, 153 aa, Sorghum bicolor
  Clone ID: 18062575.pep
HEEVMGTDGCKKDIDQIMATVDCSDNVHSDMHCKEARCVNTSLADPQQNCDCNFPDTENTSMQRSGALFTMNETEQSSNETSHKEQCMDLKRLELESSSLNNQHDSPIRYNDGHNVDITAKAASAPLSCGGESESCNATNNVEAPPVGDTEEV

SEQ ID NO: 62509 - protein, 188 aa, Sorghum bicolor
  Clone ID: 18062594.pep
KRVYAPTPMIQEPFFELPIVNAPTVPDTVMPETIAHSPVATTDENEEPVLQEPIEEPVATGEGEQQQPQPDQVPTVEAPRRSQRIRRSAIPDDYEVFNTEEFHMEGDPTSYDEAMRSANSQKWLEAMIEEMKSMNSNGVWDLEEIPKGAKTVGCKWVYKTKYDSQGNVERFKARLVAKGFTQREGILV

SEQ ID NO: 62510 - protein, 89 aa, Sorghum bicolor
  Clone ID: 18062619.pep
MDLPEKKLTDFIKGREKAKWIPVNNHNVNNFTEDEIKRITNNYSTPIGQGGFGQVYRGSLDDGTTVAVKKYICQNVKDGFAKELIVHCQ

SEQ ID NO: 62511 - protein, 186 aa, Sorghum bicolor
  Clone ID: 18062640.pep
TRVTNSLWDYTDVVMNYLCGPYTSDVGSGLNHKWLQYFDIVITGSSKPSFFHDDNRAGLFEVEPDSGKLLNADIQIGSPRSSHQHSTPVQKVYQGGNVGHLHRLLSVASSSQILYVGDHIYGDILRSKKVLGWRTMLVIPELEQEVKLLSESKSTRKELRHLRMKRDSIEDRIHHLEWSLKLDDVT

SEQ ID NO: 62512 - protein, 80 aa, Sorghum bicolor
  Clone ID: 18062642.pep
ELFSCQRTEVISHDGVLIPLVILYSREAHCHGESPGILYGYGAYGEDLDKSWCSERLSLLSRGWVLAFADVRYVQPTELQ

SEQ ID NO: 62513 - protein, 80 aa, Sorghum bicolor
  Clone ID: 18062646.pep
MASSDISVDIRPDINSFDHFLSMRYIATDRPWLKLYGIRVQPVPPFSSLSYKPDPALIHHCLPDELMLEIFTRMSPYTLG

SEQ ID NO: 62514 - protein, 173 aa, Sorghum bicolor
  Clone ID: 18062660.pep
TRPPSSFIKFVNVTFWRTPEAAESHAKMAHSTGLVQAILFEAADRDNIGGSAYGGQRSICCTPDLAKLEGCKQGEVIRRPSSDDPDWPYVLDTHFSANHLSVKLEDEPVRITKTGMYNLFFISCDPKLRGLTMSGKTIWKNPGGYLPGRMAPLMKFYVLMSLAYLLVMIVWFS

SEQ ID NO: 62515 - protein, 69 aa, Sorghum bicolor
  Clone ID: 18062664.pep
ARGSMRDVDQDTGRDLLPMSLNRGEEDAPRANPPADRAGAAGRRRKGVSGIFVPDENEDKAGPAPRRPT

SEQ ID NO: 62516 - protein, 177 aa, Sorghum bicolor
  Clone ID: 18062668.pep
TRGSQSSNSRAQGFQAQFCTLDSSSANCVYPAHSSTSSQSISGSPLSQQESHSDHAYGSSPSASCITQVPTWTLKDLENVMLGPDSDICSPDSSFLPGTALHENNWRELLGIQTGDLRQLIIACGKAVDENAFYMDALMSELRPMVSVSGEPMQRLGAYMLEGLIARLSFTGHALYK

SEQ ID NO: 62517 - protein, 56 aa, Sorghum bicolor
  Clone ID: 18062680.pep
ARGYKPSQQSAAFNSGAKERIIRMSEMAVDPLEPPKFKHKRVPRPSGTPPVPVMHS

SEQ ID NO: 62518 - protein, 162 aa, Sorghum bicolor
  Clone ID: 18062688.pep
MATGSSKSKGMFNRSKWLIVSLATGLAIAAFILALTIWYRRKRRPAHRGHVIEPLVLNRQVDGMPEEAMHDQEKKGLSREGDEEDEDGRRTSCQLYSYQHLEAATCCFSSRNKLGSGGFGTVYKGTLENGKKVAVKRLRDSKRTIQELEREISIVANLRHKN

SEQ ID NO: 62519 - protein, 200 aa, Sorghum bicolor
  unsure (1)..(200): unsure at all Xaa locations
  Clone ID: 18062698.pep
TRVFRGFKDTKTPLYATVAGDAINIVLDPIFICVFQYGVKXAAIAHVISHVXYFIASILLWRLRLHVDLLPPSFKHLQFGRFLKNGFLLLARVIAATFCVTLSASMAARQGSTPMAAFQICLQTWLACSLLADGLAFAGQAILASAFARKDYPKATATASRILQLALVLGLILSILLGIGLRIGSRLFTSDQGVLHHIYI

SEQ ID NO: 62520 - protein, 73 aa, Sorghum bicolor
  Clone ID: 18062705.pep
ARGSTVESKSSDQDKEIHGGVIPHSSDPLDGIIQKIKLLSINGPDKVVAEVPKNALVPYQGEFGALVAFKGKT

SEQ ID NO: 62521 - protein, 169 aa, Sorghum bicolor
  Clone ID: 18062716.pep
ARGPNVVSIVGAYEDAVAVHLVMELCAGGELFDRIIQRGHYSEKAAAQLARVIIGAVEACHSLGVMHRDLKPENFLFVNQKEDAPLKAIDFGLSIFFKPGEIFLDVVGSPYYVAPEVLKKHYGCEVDVWSAGVIVYILLSGVPPFWDESERGIFEQVLKGDLDFSSDPW

SEQ ID NO: 62522 - protein, 169 aa, Sorghum bicolor
  Clone ID: 18062717.pep
ARGTKDCVAKTLKRLEEKINGRVLKHLLYLMRVGEKSVQRQSALALAHLCAPEDQRTGGIDNNGLDLLLDLLISMSSKHQQDGSAALYKLANKAAALSPMDAAPPSPTPQVYLGEQYVNSSTLSDVTFLVEGKRFYAHRIALLASSDAFRAMFDGGYREKDARDIEIPN

SEQ ID NO: 62523 - protein, 147 aa, Sorghum bicolor
  Clone ID: 18062720.pep
MVHSPVAFLRKLQTSSSSLATELISFSKYAQKSMKYSWQFICQNNPLFIQVTYFTLISFAGYAALKIIKPRDEQDTLKDIDLLFTSVSASTVSSMATVEMEDFSSAQLCILTILMLIGGEVFTSMLDLYFMRATSITKGSSNRKGYS

SEQ ID NO: 62524 - protein, 185 aa, Sorghum bicolor
  Clone ID: 18062732.pep
MPKYKYVTGPPSDWSDREVAILKEGLVRYAREPNIMRYIKIAAMLPNRTIRDVALRCWWATGKERRKKPDGFYTGKKVRDMKPIQDKMVASVPIANFQMTPTTNVTPFSISMQHPNQQSQVHKEAPVVDSATQHLLEENNQLLNQISANIETFKTVENTDLFLRTSNNIKTILSRMSETPGIMGQ

SEQ ID NO: 62525 - protein, 205 aa, Sorghum bicolor
  Clone ID: 18062736.pep
TRYESCPWRFDPVETNPDNVKERATKLLDQYRKKSTLYRTNTLLVPLGDDFRYVSVEEAEVQFRNYEKLFDYIYSNPHLNAEVKFGTLEDYFSTLRDEAEKINYTRPGELGSAELQGFPTLSGDFFTYADRNQDYWSGYYVSRPFFKAVDRVLEQTLRASEILGSFVLGYCQKFQCAKLPISFSHKLTAARRNLALFQHHDGVTG

SEQ ID NO: 62526 - protein, 183 aa, Sorghum bicolor
  Clone ID: 18062771.pep
HEEDKCESSSIDHNDQNVDFGRLSARVDVTDVARTEHRPSLEASEDIKQEGHISSSATGVDEHLDAGVTSTTADEKHLDDSGMTDGTALYSPEPLFPLPAYELQDPKPDTRENSEYPCQTHGAASGDDKSMDAFGNMESTPAGHVSENRCYQQHQHGESSSKTSDHEEHITNASEDGVKHQSG

SEQ ID NO: 62527 - protein, 162 aa, Sorghum bicolor
  Clone ID: 18062779.pep
ARGEGRVNPEGVAYYKNLISYLLQKGITPYANLYHSDLPLALQNKYGGWLNPKMAKLFTDYADFCFKSFGDHVKHWFTFNEPRIVALLGYDGGSIPPQRCTKCAAGGNSATEPYIVAHNFLLSHAAAVARYRNKYQAAQKGKVGIVLDFNWYEPLTNSTEDQ

SEQ ID NO: 62528 - protein, 176 aa, Sorghum bicolor
  Clone ID: 18062785.pep
GTRDQLPPFRILKKSEYENLTNEQKSAYLDELDYRETLYLKKQWKEGIRKQKLTEAQNDEVGDDYEESASPEVVHMSDMDIPLCFDSDYPVHRYRHIITDDQLFRPVLDPQGWDHDIGFDAINFEASKELKKNVSGAITGQMRKDKEDMYIHSECSVSYNAHRGCSLMGGMDMQMA

SEQ ID NO: 62529 - protein, 166 aa, Sorghum bicolor
  unsure (1)..(166): unsure at all Xaa locations
  Clone ID: 18062809.pep
ARGGDAQLKMRNSASGLSYMVRVEVQNADLDIYNKRFSGKNNVNTGTVLILLSDDKTGFVPYRIDNFSMEKLRIYQQRCESIETIVYPYTSCQYAWDEPCYPHRLTVEIPGERSLGTFNLDILNDDVHVSLPSTSEKAERQFCISIHAEGAIKVLSVLDSXYHNTE

SEQ ID NO: 62530 - protein, 187 aa, Sorghum bicolor
  Clone ID: 18062833.pep
HEDPVERLTVEEFVHHPFLSEHAPERTLSRTPSDIRDGFPINNSSPTRPSSQSSQEDCMPFPLDDESSGQDEGPVPDSKSPMKSYGLPTGKRLDKASGQSPSKHTSLFSRYVLGNNHAPSSQHHGHTGKMTKESKIPEVHGTKGVYPEGMEVISDYLALTHFYYEQFLLKLLFLYFVNVDSPIIDSL

SEQ ID NO: 62531 - protein, 170 aa, Sorghum bicolor
  Clone ID: 18062849.pep
HEAQCQRQCGGVDIHYPFGIGDNCSLSPGFNVSCDEVQDGIPKPFIGSVELLNISLIHGTIRVLNPISTSCYNSSSGLMEGNPWLINATDSPYRFSDVHNKFTVIGCNTLAYISGSDGTGYQSGCVSTCSSLSDLADGSCSGMGCCQTAIPKGMAYYDVGFDSGFNTSQI

SEQ ID NO: 62532 - protein, 173 aa, Sorghum bicolor
  Clone ID: 18062857.pep
TRDYSGGCQRRVPLQCQTNSSSAQAQPDKFYTMESVRLPDNAQTTVAASSQDCQVTCLNNCSCNAYTYNSSGCFVWHGDLINLQDQYSGNGGGTLFLRLAASELPDSKKSNTVTIGAVVGGVAAVLILLSIVSYFLFQKYRRERTLRISKTAGGTMIAFRYSDLQHVTNNFSE

SEQ ID NO: 62533 - protein, 94 aa, Sorghum bicolor
  Clone ID: 18062859.pep
HEGTDNKYVASQQVTSVSFSNCGTYFSGSSTSNNTLVWDTRLVPINQSKDVSRSRDMRFFRPLHCFSHGSQMPTAEYTSQLPGYVKCGTNHYCI

SEQ ID NO: 62534 - protein, 189 aa, Sorghum bicolor
  Clone ID: 18062862.pep
TRVTSPNLDSITPGSVYPGSHTNGITLPNHQGSVGPSTPTSNLNSRLPGSPAMVLGSNSPSPSTSNSPRDAQKYGVPRPTSLQGDEQPKIQYNQMANGRNLHQPGVSAPGTIPSGVDCGAGARMMPSAPGMGMVAGLNRGMPGARPGFPRISSPAMLNAVPSGNLLPNSGQGVLTAVSVHPGAISGPGN

SEQ ID NO: 62535 - protein, 203 aa, Sorghum bicolor
  Clone ID: 18062864.pep
ARGESGTLGAKCNTQMVIPHLTENYGASRDPPEKQAPMCTVHSFPHNIDHCLTWARSEFEGLLEKTPNEVNSFLSNPAQYAAAMRKAGDAQARELLERVSECLDKERCNTFEDCITWARLRFEDYFSNRVKQLTFTFPEDAATSTGTPFWSAPKRFPRPLQFSATDSSHINFIMAASILRAESFGIAIPDWAKNASKLADAVD

SEQ ID NO: 62536 - protein, 135 aa, Sorghum bicolor
  Clone ID: 18062868.pep
MTDHFALSLGALFLLLLSTSGFSSELDVQCLRDVQKSVIDPNGILKSSWIFDNSSAGFICKFTGVECWHPDENRVLTLRLSNLGLQGPFPKGLKNCTSMTGLDLSSNSFTGVIPSDIEQQVPMLTSLDLSYNSFS

SEQ ID NO: 62537 - protein, 173 aa, Sorghum bicolor
  Clone ID: 18062870.pep
ARGVFERLWPAMRDDATLAASASSLSASASWRRSMLMTSHYQNSGDPWMPCVNSRLTRSELPPSNGYLMIEANGGLNQQRLSICDAVAVASLLNATLVIPTFHLNSVWRDPSKFGDIFDEDHFIETLKEHVRVVKKLPEDVLLRFNHNISSIPNMRTKAYSSPNHYVQNVLPK

SEQ ID NO: 62538 - protein, 168 aa, Sorghum bicolor
  Clone ID: 18062877.pep
TRPRGAHLSPKLTELLASYEDGLASSLRKLKPEATSEVLTLSWMKLAVDCLSELHTNIATLITELELPLSDWDQKWVDIYLNSSVKLLDICIALSSELSRLDQGQLLVRYLLNVLDSGSDMPSQEQLKKAAVSLKEWIERASERSPRLDSCLAALHELSGNLCLMKVK

SEQ ID NO: 62539 - protein, 122 aa, Sorghum bicolor
  Clone ID: 18062904.pep
MNGSYTSSISLHDVSVDDGQSALDNSSRASSPFDILTPQDVIPIEMARSRFLDLVVDYFICEHVIEMVECCGSDCSQVDGKSNKRKQQEVRYEGDPRVALPLMYIANLYETLVSDVNVRLEA

SEQ ID NO: 62540 - protein, 91 aa, Sorghum bicolor
  unsure (1)..(91): unsure at all Xaa locations
  Clone ID: 18062917.pep
QIFNTXELINVSFIQLKINNVPDFMYTKMQWPINTDQNQCEHLIIVRYADLYIFHQHCRITECLKLQILRALFAHYQNPIKSPYLIILLTK

SEQ ID NO: 62541 - protein, 157 aa, Sorghum bicolor
  Clone ID: 18062919.pep
ARGDDENGKNVAERERKASYFSWYYGVANLGILTSGTLLVWVEDKVSWGLGYGVCASFVAVAVVALAATAPVYRLVPPVGSPLKGACQVLVAFARKVNVRVPDDAAELYAEEHAKVSFLQQPRELLEHTDQFRCLDKAAVVTSADLEDGNPWRLCTV

SEQ ID NO: 62542 - protein, 180 aa, Sorghum bicolor
  unsure (1)..(180): unsure at all Xaa locations
  Clone ID: 18062939.pep
TREEPHEVESQSQYELMNPSVCNNELINPSVCNDEGNELIDEDVDIGENDPPVSTLPPVVLEDETADRSSKHSTSSSSSSGSESSSSDSDSSSSSGSDTDAKAPQQNSGPKEKILPVDGLDKEKDSLNTLNLPEQSTNPISVSADGEGGNVSEKQVSPDNPDXQIRAALLRSRFADTILK

SEQ ID NO: 62543 - protein, 161 aa, Sorghum bicolor
  Clone ID: 18062956.pep
HEATPEKTLMRRRRRRRLGWLRRLGVGVCVVDADAEEDDEVNSTSSTSSRGCSRKVARVKVRPYKKRSKELSAVYKGQVIKAHEGAIVTMKFSSDGQFLATGGEDGVVRVWRVVEGKRPDDRDFIEDDPSCVFFTVNENSELAPINSCEGSKGKHSKSSKG

SEQ ID NO: 62544 - protein, 180 aa, Sorghum bicolor
  Clone ID: 18062986.pep
TRLGIMRVPGIGLIYTELVTGVPAIFSHFVTNLPAFHQVLIFVCVKSVPVPYVPMDERYLIGRIGPREYRMYRCIVRYGYKDVQKDDENFENHLVMSIARFIQMEAEESASSAGSYESSPEGRMAVVHTTDTTGTGLVVRDSSVDAAGTSLPLTRSSKSETLRSLQSIYELESVGGVSRR

SEQ ID NO: 62545 - protein, 174 aa, Sorghum bicolor
  Clone ID: 18062992.pep
MKSLAKQETQPKPRLIVRLGAFLASHHILFSVICCFAGIIALLLLPSLAKNTYLSENALIPGSANPLFSTEDAIEANRFMKGIEAAARDSRGVIGMANFIAQQIEALGAEVCYHKFLPHSKNFHPLKFFTSMTNDIAIQPNGTTTNFGMNTVGIVRAPRGDGKEAIVLVTPYNS

SEQ ID NO: 62546 - protein, 185 aa, Sorghum bicolor
  unsure (1)..(185): unsure at all Xaa locations
  Clone ID: 18063004.pep
PREEENTEAVPVAVGDPVKVTGKGRKQKKHYASFEYEGNTFELEDPVLLTPEDSTEKPYVAILKDITETEGSLYVTGQWFYRPEEADKKEGGCWVARDTRELFYSFHIDDVPAESVMHKCVVHFIPQHKQIPSRKQHPGFIVQKVYDAVEKKLWNLTDKDYEDNKQQEIDLLXXKTIDRIGQLPD

SEQ ID NO: 62547 - protein, 74 aa, Sorghum bicolor
  Clone ID: 18063010.pep
SKVKKRHLGIWTLQLSFPTMCEKIFICMVFGSTSGCGLHKYDKKVTQPDSDTCTPCAPCGTTINSRLDHTLLES

SEQ ID NO: 62548 - protein, 182 aa, Sorghum bicolor
  unsure (1)..(182): unsure at all Xaa locations
  Clone ID: 18063017.pep
ARGKGLSEFEGSEDGKXIWALRLKATLDRSRRLTEEYSEALLSIFPEKVKVLGKALGIPENSVRTYTEAEIRAGVIFQVSKLCTVLLKATRAVLGSSVWDVLVPGVAHGALIQVERIAPGSLPSSIKEPVVLVVNKADGDEEVKAAGDNIVGVILLQELPHLSHLGVRARQEKVVFVTCEDD

SEQ ID NO: 62549 - protein, 88 aa, Sorghum bicolor
  unsure (1)..(88): unsure at all Xaa locations
  Clone ID: 18063036.pep
NNNNEFYAMNTSCTWICTMDFFRIIITHKLNILCILLILYAYIFVLLLILYVYIFVVSRLFFIFSLSLLHNHSSSLLLQFYEWNWIYX

SEQ ID NO: 62550 - protein, 192 aa, Sorghum bicolor
  Clone ID: 18063045.pep
TRLQRCFAYCSIFPTTWRFNRYDLVKMWMALGFIQPPTDEGKGMEDLGQKYFDDLLSRSFFGTANKDQQTYYFLDDLMHSLAQHFSAHDCMKINEDVPVVIPPTVRHLSISTDYLPQLKSKYRLGRLRTLLVLRSPSLSSSHFPRKLLAKFKNLRVLDLSESDIAELPETISQLVHLHYLAFSGIANKLPKS

SEQ ID NO: 62551 - protein, 186 aa, Sorghum bicolor
  Clone ID: 18063047.pep
TRVLEDTRAPDSFAEQCEVQLGPPLEGGRITMSSVQFGSSTCKASSEHSFAEQCEVPAPCIDSVDYMDLDTEAAAEVVLDDSVGRPNNNSEIPTANGMSGEPKPSFSSGFFDKPSRKRSSFAEEDSAGSPRKLNGYCNGHLSSLEQGILANSGSEKCNGDTLATSSNGNCYAVNGDAQSRNDSLDA

SEQ ID NO: 62552 - protein, 60 aa, Sorghum bicolor
  Clone ID: 18063063.pep
KLQSIPESIIARLLNVVVLDVRSNQLKSLPNSIGCLSKLKVLNVSGNLLQELPATIEECR

SEQ ID NO: 62553 - protein, 155 aa, Sorghum bicolor
  Clone ID: 18063077.pep
TRIESKEQELLVANQAIARQEATVRELQSEIKRKETDIERLNDLTKANEEKLKVAEQDLEKQNSGWIAAQQELKELAQMASKDKDNIKNTISDFKRVRSLLDAVRSELIASKEAFTFSRKQVEDQAAQLSNKVQELTDQKALIISYTRNLEAAQL

SEQ ID NO: 62554 - protein, 202 aa, Sorghum bicolor
  Clone ID: 18063078.pep
ARGDYYILVMDMLGSSLWDVWNSVGQAMAPHMAACIAVEAISILEKLHSKGFVHGDVKPENLLLGQPGSLDEKKLFLIDLGLASRWKEAISDKHVEYDQRPDIFRGTIRYASVHAHLGRTGSRRDDLESLAYTLIFLIRGRLPWQGYQGDNKSFLVCKKKMTTSPEMLCSSCPAPFKYFLEMVTNMKFDEEPNYSKLISLFD

SEQ ID NO: 62555 - protein, 76 aa, Sorghum bicolor
  Clone ID: 18063094.pep
LSLRPANRQSQSLQSHDGRHVKHSVNVDNFFLLKSQKRRKQQLIIVGIEYTSCFPGVSRRCLGIARNIELDKHLLR

SEQ ID NO: 62556 - protein, 41 aa, Sorghum bicolor
  Clone ID: 18063118.pep
NSIRNMLAIYSASHNATQKDYIYIQLGRREVVCVEAGLPRA

SEQ ID NO: 62557 - protein, 204 aa, Sorghum bicolor
  Clone ID: 18063130.pep
ARGSHGSGAYLFKPVGEARSIVEGGGHFILTEGPLVQEAHSLPKTEWHESPLSHSTRMYNCGDSVQDMLIEKEYHVELVGHAFNDKELIVRYKTDIDNQRIFYSDLNGFQMSRRQTYDKIPLQGNYYPMPSLAFLQDSHGKRFSVHSKQSLGAASLKNGWLEIMLDRRLVQDDGRGLGQGVMDNRPMNVIFHLLMESNVSALPK

SEQ ID NO: 62558 - protein, 52 aa, Sorghum bicolor
  Clone ID: 18063134.pep
NHSFSYSGGIDFISYVYRIFHFKSFSLLCKLVVYNNQYINVPAGYMFVIFFY

SEQ ID NO: 62559 - protein, 48 aa, Sorghum bicolor
  Clone ID: 18063140.pep
HGRELMADDEGIYISIQEDTSSSSSSSRCYNSVRSGGIFLKKKSQEEG

SEQ ID NO: 62560 - protein, 80 aa, Sorghum bicolor
  Clone ID: 18063150.pep
TRQPFSHYDRVLRKMVRLAPSSPHWHLVEHVLCLPASCLTVCVSLTATVACILCLLNCSVHLCPCHNEYGQLGIRVDPSW

SEQ ID NO: 62561 - protein, 158 aa, Sorghum bicolor
  Clone ID: 18063178.pep
QKQYLDSNTIDVDKSSESSMGVSSKELSDTDSSFGCRENQLDFVSKEQQQNSSCDKEQSDRKREIITCDASEVSDHFVPEDTSSDQSGAKHHELDSASGIQDESGAKNCDDSPKGNVDDEELDLFITDTILPLMRSRLCEDCESSPSSQGSPSRNFDT

SEQ ID NO: 62562 - protein, 137 aa, Sorghum bicolor
  Clone ID: 18063186.pep
ARGFSSSNASSLSLPSSDSSYASNYRGANVLQDSYLKLRCEVVGANIVKSGSGMFAVYSISVTDANGNNWSIKRRFRHFEELHRRLKEYAQYNLHLPPKHFLSSGLEVHVVRERCKLLDIYLKINLARNRHFLCFSL

SEQ ID NO: 62563 - protein, 172 aa, Sorghum bicolor
  Clone ID: 18063193.pep
ARGVKQRQYNPSSGMYSLDVVQISRVQADQRAGRAGRTRPGKCYRLYPISIYQNEFLEATVPEIQRSSLAGSVLYLKSLNLPDINILKFDFLDPPSRESLEDALRQLYLIDAIDENGEITDVGRVMAELPLEPSLSRTLIEANELGCLSQALTVASILSAEITLRSASDMDG

SEQ ID NO: 62564 - protein, 175 aa, Sorghum bicolor
  Clone ID: 18063208.pep
ARGAVLQMLEKQMGPDSFRKILQVIVAPNRASRTLSTKEFRHLANKVGNLERPFLKEFFPRWVESCGCPIMRLGISYSKKRNMIELAVSRGCTAKATPDPDIHTNGDTREGDAGWPGMMSVRVHETDGAYDHPVLPMAGEALQVVEIQCHSRLAAKRVWKKKNTKLDGSDDNIDA

SEQ ID NO: 62565 - protein, 88 aa, Sorghum bicolor
  Clone ID: 18063227.pep
ARGHYQWNMDIFGVPKVRAEAELLNAIVLLFQHLGITSSDVGIRVSSRKVLQAVLNMYSIPEHLFTEVCVIVDKVCPNSAIDLPSVHC

SEQ ID NO: 62566 - protein, 169 aa, Sorghum bicolor
  Clone ID: 18063232.pep
TRLQLLNDMKGSPLCQPDVYTYSTIIKACVDATRFDLIDVMYKDMAERSIAPNTVTQNIVLSGYGKAGRLDDMEKVLSDMLDSTACKPDVWTMNIILSLFGNKGQVELMEKWYEKFRSYGIEPETRTLNILIGAYGKKRMYDKMSAVMEYMRKLAFPWTTATYNNVIEA

SEQ ID NO: 62567 - protein, 200 aa, Sorghum bicolor
  Clone ID: 18063282.pep
HEAFQEKMLRTWIQYNRPSEPNFTHAGLLLAFGLHEHLRVLTMTDAYRYLSQEHDITTLGLLLGLAASHRGTMDPAISKMLYFHVPSRHPSSTPELELPTLLQSAAVMGIGLLYEGSAHALTMKILLGEIGRRSGGDNVLEREGYAVAAGSALGFVALGHGNCAFEFMDTFLDRLFEYIGSKEVYHEKYLNATTADDQSC

SEQ ID NO: 62568 - protein, 177 aa, Sorghum bicolor
  Clone ID: 18063292.pep
TRSNLTFLDVSNNYLSGVIMEEHFEGLISLKKLDLSSNKNLKVTVNRDWFPPFRLEYGNFANCQMAPLFPAWLQQQFQISHLDMSSTYLKDKIPEWFWLTFSQAIYIDISDNKLSGSLPAHLDGMAILELNLSSNLLTGPVPSLPRSIITLDISNNLFSGKLPLNFGAPTLATLIMF

SEQ ID NO: 62569 - protein, 180 aa, Sorghum bicolor
  Clone ID: 18063294.pep
ARGAAQRLARYFAEGLEARLAGSGSPVYNSLMAKRTSVVDFLKAYRLYAAACCFRMMAFKFANLTISKAIAGRKKVHIVDYGIHYGSQWPGLLKILTLWPGGPPEVRITGIDLPQPGFRPAARVKETGRRLSSYASQFGVPFKYRGIAAKWETVGVDDLDIDPDEVLIVNSILHFGNLMD

SEQ ID NO: 62570 - protein, 211 aa, Sorghum bicolor
  Clone ID: 18063295.pep
TRGFAADAWIGSCLIELYSRCGSMWAAEEVFRRMEAPDVVGYTSLVSALCRNGDLARAVEVLCQMMRQGLQPNEHTMTSMLAECPRMIGEQIHGYMLKVMGSQSVYASTALIDFYSRYGDFDMAETVFENLDSKNVVSWCSMMQLCIRDGRLEDALRVFSEMISEAVEPNEFAFSIALGACGSVCLGRQIHCSAIKCNLMTDIRVSNALLS

SEQ ID NO: 62571 - protein, 199 aa, Sorghum bicolor
  Clone ID: 18063331.pep
TREKGKDRSDKEVVTPWFKFLWETYRTVLEILRNNSKLEALYAMTAHRAFQFCKQYKRTTEFRRLCEIIRNHLANLNKYRDQRDRPDLTAPESLQLYLDTRVEQLKVATELSLWQEAFRSVEDIHGLMSMVKKMPKPSILVVYYAKLTEIFWISDSHLYHAYAWLKLFNLQKSYNKNLSQKDLQLIASSVLLAALSVAP

SEQ ID NO: 62572 - protein, 88 aa, Sorghum bicolor
  Clone ID: 18063341.pep
FILHFIHRRLSSFPALLHAAALSLSLPPPLILLSSTLLPELLSVAPSLSLSLSLTIPLSLPQLASLPLYPALSPFLSLSLYLDHISLR

SEQ ID NO: 62573 - protein, 46 aa, Sorghum bicolor
  Clone ID: 18063380.pep
HKTSLDLLGENWTFFLSPQKEGSIQDCMFVLESDNIAHQLSTINLS

SEQ ID NO: 62574 - protein, 164 aa, Sorghum bicolor
  Clone ID: 18063382.pep
HEAQIELDLRDIKDRIVNEKRAKDEAARDLQSVRRESEKSKSELAEISKVHQTKLKEEEEISKSIMDREKRLSILYQKQGRATQFANKAARDKWLQKEIEDLKPVLLSNRKQEGLLQEEIQKLKDEINDLTNYIESRKNESSKLEEALAKRHNDYNDLRKQRDV

SEQ ID NO: 62575 - protein, 67 aa, Sorghum bicolor
  Clone ID: 18063393.pep
HEGIYLSMHASLPPIDSFLLSIHCYYDDDDLNNKMLSTSSSIICCCYCFVCFIFCFRCCFQASLLFC

SEQ ID NO: 62576 - protein, 52 aa, Sorghum bicolor
  Clone ID: 18063396.pep
LAQLQGTYILQGDYDLKVMRQEYYINRQKTFINHLVNQLARHQFLKIACQLE

SEQ ID NO: 62577 - protein, 190 aa, Sorghum bicolor
  Clone ID: 18063409.pep
MPLPAFLAAAARLAVLVAAAVTAANAASFARYRRRHLRRIPNPIDESADPIADFRALPSNSAAASAGEDVAEDGNFFFGLATAPAHVEDRLEDAWLQFAVEHSCDDKEAMRDHKTADAVMASAAGDGGAQLASRSRGDEKAVDGEKRKPLKVAMEAMLRGFEMFAYGGEAGSGDNCSHNVAAWHNVPCPQ

SEQ ID NO: 62578 - protein, 81 aa, Sorghum bicolor
  Clone ID: 18063417.pep
MPALQMAGMAMPAYATYIARLQQSLAASASAYKMNFGMAANSPLQQQLLANANWPYGMAGRYGMQSSGWPFGNSNPNQFPG

SEQ ID NO: 62579 - protein, 185 aa, Sorghum bicolor
  Clone ID: 18063435.pep
ARGPRGMARREQNRSRHNYRKDCIYWTLEWRFNSTDVVLTDHEVDEHTTLLSLLEKHLSPGPWKDQLTQYRNTDLHDLKLFIQKCAKRSESPYRLLNIEEPLRPQLRGILVVEYPTINVFLPSDNYDFEIEKMVNSLHKDGKNPGSRTDEPPVEGSEFHEEEIEEGEFSPETEIIDLKDCGASNA

SEQ ID NO: 62580 - protein, 191 aa, Sorghum bicolor
  unsure (1)..(191): unsure at all Xaa locations
  Clone ID: 18063455.pep
ARGQLSVQWPDTVFHEHLYRTLIELGLENELLEYGGSDLVSFLQSAGRKHQEEVRSISSVTSGAAKLHDLGAPISTSQTKYLELLARYYVRKGEHIAAARMLLILAERQCSNSEEAPTLDKRYEYLRDAVLQAKSAGISADSSRNPIDSSTVDLLEGKLAVLRFQMQIXQELELMAARIENIPSSSESPSV

SEQ ID NO: 62581 - protein, 198 aa, Sorghum bicolor
  unsure (1)..(198): unsure at all Xaa locations
  Clone ID: 18063470.pep
TRAPHPMEPDAAQNPSPVPPPISAYYQTRAEHHAVVSSDWLAHAAAAAAAFPGADAADAAAQPPTPSSPGAAGGVIEEFNFWRRKPEAAEAVAAIMALAAVIRSSRATTMMELEIELKKASDKLKSWDATSISLSAACDLFMRFVTRTSHLEHEKFDAAXSRLIERGEKFGEISLKARKTIAMLSQDFIYDGCTILVH

SEQ ID NO: 62582 - protein, 180 aa, Sorghum bicolor
  Clone ID: 18063482.pep
HEGDLDDFFGGPAFLAWARMGNLHGWGGPLSQNWLDQQLALQKKVLSRMIELGMVPVLPSFSGNVPAVFAKLFPSANITLLGDWNTVDANPKWCCTYLLDPSDSLFIDVGQAFIRQQIKEYGDVTNIYNCDTFNENTPPTDEPAYISSLGSAIYEAMSRGNKNAVWLMQGWLFYSDAAFW

SEQ ID NO: 62583 - protein, 200 aa, Sorghum bicolor
  Clone ID: 18063504.pep
ARGPCENSEFAQLPQPQPPSPEMAPPLCDYSEPAQPSPLCHPDECTGASPDAPVDEVVAGTSGKAARPSPCENSEFAQLPQPHLPAESTYVCSNAAGKVSAVASEDGTQPAMESIDSEGPLEIGVQRSLQEPEETTTPSRMEAEPCSPEMAPPGFEDCKSQWLPLSDPNPLVESTHTVVQVTATNAMDTTPDTATGSLSP

SEQ ID NO: 62584 - protein, 85 aa, Sorghum bicolor
  unsure (1)..(85): unsure at all Xaa locations
  Clone ID: 18063538.pep
FQLPDFIAATGIEKIIQAYIEKEDSKKLKQKQRERMQPKMGKMDIDYQVLHDAFFKYQTKPKLSSHGDLYYEGKXFEVKLREMKP

SEQ ID NO: 62585 - protein, 204 aa, Sorghum bicolor
  Clone ID: 18063550.pep
ARGEKRYWQRYIYLWINYALYEELDAQDMERTREVYKECLRLIPHKKFTFAKMWLMAAQFEIRQKNLKAARQILGNAIGMAPKGKIFKKYIEIELYLGNFDRCRTLYEKYIEWSPANCYAWRKYAELEKNLSETDRARSIYELAIAQPALDTPEVLWKEYLQFEIDENEFERTRQLYERLLDRTKHLKVWISYAEFEASAGLGS

SEQ ID NO: 62586 - protein, 124 aa, Sorghum bicolor
  Clone ID: 18063594.pep
MATEASTSAAGGSWVEGMSADNIKGLVLALSSSFFIGASFIVKKKGLKKAGASGVRAGVGGYSYLYEPLWWAGMITMIVGEVANFAAYAFAPAILVTPLGALSIIISAALADIMLKEKLHIFGI

SEQ ID NO: 62587 - protein, 106 aa, Sorghum bicolor
  Clone ID: 18063613.pep
MARGGSTAAPPPLPPLLLLLVVVVVSSAFFARCCHAAPPGALVTSVPGYTAGSGALPSKHYAGYVTVDEAHGRRLFYYLVESERDPAKDPVVLWLNGGPGCSSFDG

SEQ ID NO: 62588 - protein, 181 aa, Sorghum bicolor
  Clone ID: 18063623.pep
PSVGKRTLVAHVCSDKRVTSHFSLILHLNEGDLFRVQEEHESRRAAEGKVLIVVEFDSVVDEEDWVKFYSSVTNLKKGSKVVIISNLRKFDTFATVKPIFLSTLPYAEFRYLFKILAFGSTNPMEHPQLLKIVDELSKELQLGWSLVTANALGEALRTNLDVRFWLCMLNRIRRTSERNLV

SEQ ID NO: 62589 - protein, 177 aa, Sorghum bicolor
  unsure (1)..(177): unsure at all Xaa locations
  Clone ID: 18063654.pep
TREQSTAEEVADRYLRELIQRNMLEVVDNDELGRVSTCKMHDLVRELVLSISKEEKYGCAYDFSSMSHMDKDVRRLSSCGWKDKIAVKANFPRLRTLVALGIISSPSQLLSPILSESHYLTVLELQDSEITVVPASIGNLFNLRYIGLRRTRVKSLPESIGKLSXLLTLDIKQTKIE

SEQ ID NO: 62590 - protein, 81 aa, Sorghum bicolor
  Clone ID: 18063660.pep
NPLAEKRGAELKNMERSNPKNPLYHRSVMGGLSRIAEHPNSLDTYQSTNQNFVLFIFCRYFTDTYPTRIQYGIRGQPHVSV

SEQ ID NO: 62591 - protein, 189 aa, Sorghum bicolor
  unsure (1)..(189): unsure at all Xaa locations
  Clone ID: 18063697.pep
HEGKVVMLFQNCRQAAVTIQCSWRQKLARKELRRLKMAANEAGALREAKNKLEKKMDDLALRLTLERRLRAASEDSKSAEILRRDKIIESLSAECAAAKSAAQNEHDKNLLLQKQLDDSLREIAMLQSKKIMSAEAEKENSNLKNLVESLSMKNSILENELTVTRTSSDDXMEKLKDVEGKCNHLQXNL

SEQ ID NO: 62592 - protein, 201 aa, Sorghum bicolor
  unsure (1)..(201): unsure at all Xaa locations
  Clone ID: 18063706.pep
TRDDRSMAAAGIAVSVSMGALKPVLEKLATLLGDKYKKLKGLRKEVSFLMEELSDMKVLLENMDNAEDELNSQAKKWRKDIIDMSYDIEDCIDNFMDRVGDADDKVGILKKASHYLRTIKDRYRIANQINEIKSRVMEASKRRDRYNLNVCTSGSTTIVAVDPRLTALYTDSTTLVGIGTXKEELVKWVEDEEKQLKVMSI

SEQ ID NO: 62593 - protein, 119 aa, Sorghum bicolor
  Clone ID: 18063730.pep
LSSFLAANHVRSDSGCTDVDMTDVVGRQSPEESDVSAIYKGSKHHGKENDDPNESSHWLHRNDDYMRQKRPPFRLCQTESSNGIIINSGGYSNTARQLTKQNWYLNMDAPSKEKLLQER

SEQ ID NO: 62594 - protein, 75 aa, Sorghum bicolor
  Clone ID: 18063777.pep
PFPSLNYRLMLNFVPKLPKWPLHSKFTFGVNFIHGHFSPQTFLLGSFLLLILRGTPHYHASSTPAPSRAEVNGLY

SEQ ID NO: 62595 - protein, 210 aa, Sorghum bicolor
  unsure (1)..(210): unsure at all Xaa locations
  Clone ID: 18063842.pep
ARGGACAVTFTVGGLSAINGVAGAFSENLPVVCIVGGPNSNDYGXNRILHHTIGLPDFTQELRCFQTVTCYQAVVNNLEDAHEQIDTAISTAIKESKPVYISISCNLPSIPHPTFSRHPVPFFLSPRLSNHMNLEAAVEAAVAFLNKAVKPVLVGGPKMRVSKACKAFVELADACGYPVAAMPSAKGLVPEHHSRFIGTYWGAVSTPFCA

SEQ ID NO: 62596 - protein, 35 aa, Sorghum bicolor
  Clone ID: 18063843.pep
HEDDLYSYFCFLKYEPYSKFSNFKYMIKHQITRDS

SEQ ID NO: 62597 - protein, 80 aa, Sorghum bicolor
  Clone ID: 18063852.pep
ARGSCEAIFGLVMSMDVTRYEWDCSFQYGSLVEEVDGHTAILYHRLRLNWCSMLVWPRDLWYLRYWRRNDDGSYVVLFRS

SEQ ID NO: 62598 - protein, 168 aa, Sorghum bicolor
  unsure (1)..(168): unsure at all Xaa locations
  Clone ID: 18063855.pep
ARGKTSILVFKDRERYITGEHRFQKGFDKSSNRKMVKLWAEKEFRNLRRIHAAGIPCPEPISLKLHVLAMGFLGDKRGWAYPRLRDANLTGDDVDQQWRNLYVQLLGLMRRIYQVCRLVHADLSEYNILYHDKKLYIIDVSQSVEPDHPRALEFLRMDIXNVGDFFRR

SEQ ID NO: 62599 - protein, 180 aa, Sorghum bicolor
  unsure (1)..(180): unsure at all Xaa locations
  Clone ID: 18063856.pep
TRIKPSLFDGIPNGDMLXDGTQVQIRSVVLNKYVSAANGGGSNVTVDRDVASTWETFRLWRVSDNEFQLRCLGGQFLTVNSEDGLILATAKHPLSTETFFIERNAGRVHIRPLNGGYVQXWDNNLATFELVIVANNLRGDYQLANGYGSEKAKMVLEXSFITADDFDFLSRHGISTVRIP

SEQ ID NO: 62600 - protein, 161 aa, Sorghum bicolor
  Clone ID: 18063863.pep
MASSGGISDQLFVSVKLESPRLAELDLAPHLFGSHPVAGSWDPCKALPLERAATSVWEFSCVVPSQHESLDFKFVLKREDDSSQYIIEEGPNRPLGCQSNEFEMRTAVFKLNEGKEVLECKVQIETEMLSPFDLAASWRAHQEYFQPSRVRGTHDVTINPG

SEQ ID NO: 62601 - protein, 65 aa, Sorghum bicolor
  Clone ID: 18063866.pep
TRIFQTTDIIIVASLRTLANSCMLPKHFSKRCICPIGKFLVGTIFSLNKLAPCGLIETTKKCVAT

SEQ ID NO: 62602 - protein, 147 aa, Sorghum bicolor
  Clone ID: 18063889.pep
MITQPPEMQMVVMDSSGPLVPSSIGSTTNKHHAVDDIVQPSACSLVISYDITNVRTIKVATGFAIPGREFHGSPIPNDYARVEVLTVVEGHEDDLLDIPTTEGIEKLGQAINNFILWPRRDIRLDNPVPPIPTSILDERGFSHACSS

SEQ ID NO: 62603 - protein, 171 aa, Sorghum bicolor
  Clone ID: 18063905.pep
HEALTTSKYGISKMELLRACFSREWLLMKRNSFVYIFKVVQLIILGTIAMTVFLRTTMHRRSVEDGVIFLGAMFLGLVTHLFNGFAELAMSIAKLPIFYKQRDLLFYPSWAYALPTWLLKIPISFLECAVWIGMTYYVIGFDPNIERFFRHYLLLVLISQMASGLFRLLAA

SEQ ID NO: 62604 - protein, 87 aa, Sorghum bicolor
  Clone ID: 18063908.pep
FQILILHSLLIFNQRLHLWSVYRRASLPCTFFFLSGMQQELIVKYFGLRRSMRFGDKKTKNDIQARAAVCYSKGRKFNFFILPSRAS

SEQ ID NO: 62605 - protein, 194 aa, Sorghum bicolor
  unsure (1)..(194): unsure at all Xaa locations
  Clone ID: 18063915.pep
HEARFKAIPSHSTRRAIFDHYVRTRAEEERKEKRAALKAAVEAYKELLEEASEDINQKTDYQEFKRKWGADPRFEALDRKEREVLFNEKVKAVQEKVQSMRKAVNADFKSMLRESKDITSTCRWAKVKENFRSDPRYKAMKHEERETIFNEYIVELKSAEQEAEQAAKAKVDEQAKLKERERETRKRKEREEQX

SEQ ID NO: 62606 - protein, 195 aa, Sorghum bicolor
  Clone ID: 18063927.pep
TRLVNSAIQLEARVPLQIRVSQKSNRLLNEEDVLGNLPFSVDQPGIFWKEKDEDSEWNKANENADLEEGYDSSKDEVSSVSSYNPSKANPEFSLRSSLSMQSLSSRLSTSEPFYNQVERPNFPSYSPIPRFSVSEISDYHDGGLVAPQGKLNLLLPDHPLNGQRVSPDSDHSDDVGLPLTPNVDPAGSEGFTTGR

SEQ ID NO: 62607 - protein, 77 aa, Sorghum bicolor
  Clone ID: 18063950.pep
RIRRGRLLVAVPHAPTSGTHGVGHLGERRAEAELRWGARARRESEAAACAVRAHFIRLHCATAAPRSRGRWRARPSC

SEQ ID NO: 62608 - protein, 168 aa, Sorghum bicolor
  Clone ID: 18063960.pep
HEAVKAAQKKFNSLNHEYEIALDFRSSIEVCVDDDSNIPRPHYNFRQISEIENLEAGTIVDLIGIVTSVGPSGTIIRKLDNSEVQKRNLQLKDMSGRSIELTLWGKFCDAEGQQLQLQCDSGLNPVLALKGARVTEFSGKSVNTTGSTHVKVDPDFPDAESLRRWYAT

SEQ ID NO: 62609 - protein, 191 aa, Sorghum bicolor
  unsure (1)..(191): unsure at all Xaa locations
  Clone ID: 18063969.pep
HEACHSSALGGHSGFPATYTRMKQMFAWNIXGAVREYVTSSVTCQRAEPDRARLPGRMQPLPVPTAAWQIVSMDFVEGLPRSKQVNCILVVVDSFTKYAHFVPLRHSFTASSVAQLFLSHIYXLHGLPNAIVSDRDRIFTSHFWRELFRLADVQLQMSSSYHPQSDGQTERLNQSMETFLRCFAHATPTKW

SEQ ID NO: 62610 - protein, 207 aa, Sorghum bicolor
  Clone ID: 18063979.pep
TRILAHIVYIDCSKLALGKAKETRQEIEDRISEALLHSPSIIIFDDLDSVISVSSDPQVSQSSSSSDSLVRYLTDIMDEYKDKIRNTCGYGPMAFMASVQSLQSLPQDLTSSGRFDFHIELPALAVAERKALLQHQVEEHELLCSEEVLSEIASKCEGYDAYDLEILVDRAVHAAAYRFLLPSNASHNSLKQTLLMEDFSEAMHGFL

SEQ ID NO: 62611 - protein, 97 aa, Sorghum bicolor
  Clone ID: 18064010.pep
HSGIHREAQLIEGNHQSNLVAIYVHSHVHEYLSLPCMMKLTLLLPHRATTSCSTPASTFMSTSSLSMPSPWPLDTKKVNIKVEITSTTVFSHLPTLA

SEQ ID NO: 62612 - protein, 157 aa, Sorghum bicolor
  Clone ID: 18064024.pep
TRHHSQIHGTNSSSQQQAYAVHLAKERQMQRHMAPQQHSDLSGASAVPNVQNSTQILQQNQASSANPVPCSKPQHQRQQAAQNLLDSSSPNQPATTTQQKQKKQQGQQQSRQNQSQRNHGSQQAKLMKSLGRGNMMPQSPPIDSIPSNAACTPSKNH

SEQ ID NO: 62613 - protein, 117 aa, Sorghum bicolor
  Clone ID: 18064031.pep
MAGAFALRLVPRLAAEPPGRGKGGGGGASRDAGSRALVSKKPNKQQHLWIRKETAGSGKKALRLIDAPVSKLPNEREAIYGALDKWSAFEPEFPIIAAAKALGMLKRRQKWLRIIQV

SEQ ID NO: 62614 - protein, 180 aa, Sorghum bicolor
  Clone ID: 18064052.pep
HEGLFDCLPSTLRPSSESQPEGGKNPSENHQNSEAAVYSPPALIEPKFVPLLSKLAQQLVQAGCQQQCSEIYSEARSSALESSLKNLGVEKLSKDEVQKMPWEILESKIGNWIHFMRIAVKLLFAGERQLCDQVFECSQSLRDKCFAAITKNSLATLLSFGEAIAMSKRSPEKLFVLLDM

SEQ ID NO: 62615 - protein, 108 aa, Sorghum bicolor
  Clone ID: 18064065.pep
MYGASDPTAAERTAFRCAEKQYKLYKPLNLKGRSRSRSKLSGGEGGGADLSAVVDFHVLLAADGELPAGIGRHDCVGFDRPVFCFLDRPGFYFIPGALSTEEQCCWIR

SEQ ID NO: 62616 - protein, 172 aa, Sorghum bicolor
  Clone ID: 18064068.pep
HEAGKGIVFIPVKDADGSYHPMESGNSLSGGAVAGIVIACIVILIVGIWLYYRQQKMRKAVSLSSPEDSVQLSKASQTEGMKVDRSIEFSYEELSDATNNFSMEHKIGQGGFGSVYYAELRGEKAAVKKMDTKASHEFLAELKVLTRVHHSNLVHLIGYCVESCLFLVYEFI

SEQ ID NO: 62617 - protein, 55 aa, Sorghum bicolor
  Clone ID: 18064084.pep
MFFFSRFIKKIRATLEAYTKRLQFQCLVSNGFHILHSGFLPVDANYKSSIFSLLH

SEQ ID NO: 62618 - protein, 185 aa, Sorghum bicolor
  unsure (1)..(185): unsure at all Xaa locations
  Clone ID: 18064092.pep
TRLEEGLSQGRLIHNHPLQVALASQSLVQLGFLMALPMMMEIGLERGFGQALSDLIMMNLQLATVFFTFSLGTKTHYYGRMLLHGGAQYRGTGRGFVVFHAKFAENYRLYSRSHFVKGIELMILLIVYQLFGQSYRSTIAYIFITISMWFLVLTWLFAPFLFNPSGFEWAKIVDDWSDWXKWISN

SEQ ID NO: 62619 - protein, 100 aa, Sorghum bicolor
  Clone ID: 18064103.pep
MVVMEGTAIGTAIESKPGNEQKDSLTEVLRTTETLVARDCEVEKLIGLEDDTELTPYEGMEFESEDAARDFYSTYARSAGFRIRISRYTRSRRDNSVISR

SEQ ID NO: 62620 - protein, 165 aa, Sorghum bicolor
  Clone ID: 18064113.pep
MFLRQSSKLSSQFARQAAARQFSTRAVLRQEVRDAYILSASRTPTAKFNGSFTSVSAPQLGAVAIKSALEKSKVPVDKITDVYMGNVLQGSVGQAPARQALIFAGLPSSVEAITINKVCASGLKAVVFAAQNIQLGLAEAQIAGGMENMTRVPYYVPRSSSLPPF

SEQ ID NO: 62621 - protein, 165 aa, Sorghum bicolor
  Clone ID: 18064143.pep
ARGAISLILTERSPVPQSSTIKNEPCEAVTLDDDDEDDSVEPHPKKLMQTCSSKVTTNTVKQENPFVAIKTRPAAGTLVVCPTSVLRQWAGELKNKVTSKANLSFLIYHGSNRTKDPNELTKYDVVLTTYSIVSMEVPKQSNPDSDDEEKGKPDRYGAPVSSSGS

SEQ ID NO: 62622 - protein, 76 aa, Sorghum bicolor
  Clone ID: 18064145.pep
IILSIGVTPRKQRQRLLPSGANSRKLLIKRIIQETNLGGNISAISPQIIKRNPNSQRRNGDCRRIELDPNDGEPER

SEQ ID NO: 62623 - protein, 86 aa, Sorghum bicolor
  Clone ID: 18064147.pep
MGRSFRDSLKVLEADIQHADSIASEFRREYDGACLQMRMAYCPAARFFLFLVQWTDCNLAGALGLLRILIYKVYADGTTTMCTHER

SEQ ID NO: 62624 - protein, 162 aa, Sorghum bicolor
  Clone ID: 18064153.pep
TREDASAAAGDEVVKEVVLDSAHTWRLNELEAITNQIKALENMMHGDLLEAGAKSPERQDDEALAVLDADEEEVTREFLMLMEQGEDKDDANAKSSAPQVSSLKSGAKPGSGVDATCYISDLGKGLGPVVQTRDGGYLAATNPFDIPVERKELPKLAMQLSK

SEQ ID NO: 62625 - protein, 152 aa, Sorghum bicolor
  Clone ID: 18064193.pep
ARGYAPKEVSKKDNSRDRPNTGAKMDDLKDAPKVPEKEGLGDAPKKASKKQRPSGDDNHSVRKDKDIHHSQKLVTNMSGRADESKDRNLSEIRERKGDVMRSEYQKEPGKRWNDEAVGDDKIKFKSEKLRNETKRKDRSFDNERSPEVDRPM

SEQ ID NO: 62626 - protein, 170 aa, Sorghum bicolor
  Clone ID: 18064194.pep
TRPKHNSESKIVLTTRIEDVCDRMDVRRKLRMDCLPWEPAWELFREKVGDHLMGASPEIRQQAQALAMKCGGLPLALITVGRAMASKRTAKEWKHAITVLKIAPWQLLGMEFDVLEPLKKSYDNLPSDKLRLCLLYCSLFPEEFSISKDWIIGYCIGEGFIDDLYTEMDE

SEQ ID NO: 62627 - protein, 164 aa, Sorghum bicolor
  Clone ID: 18064199.pep
HEGKSQAECSASQDDDLDDDSGGMRRSGSRGTKRSRTAEVHNLSERRRRDRINEEMRALQELIPNCNKIDKASMLDEAIEYLKTLQLQVQMMSMGSGLCIPPMLLPPTMQHLQIPPIAHFPHLGMGLGYGMGVLDMNSTAAVPFPPMPGAHFPCSMIPGTPPRC

SEQ ID NO: 62628 - protein, 189 aa, Sorghum bicolor
  Clone ID: 18064203.pep
TRVKMASVAEAASSLALVGYSSSEDSMVDAAARVADGDFADSKGAGVDCQETMPTQATSTLPENMDWQNDSLAAAAVTVEPMFASSSEHAAESKPIDETSVMQVELATSTGDECAAEGDNVVSSETVVESEPVQETVVPSQGGSIEANNTSTISEVDKDTESRASGEVCKDAQSHGGESYTELQLAPSS

SEQ ID NO: 62629 - protein, 169 aa, Sorghum bicolor
  Clone ID: 18064204.pep
TRDVLVSGLNGLGAEIAKNLALAGVKSVTIHDVKMVEMWDLSGNFFLSEQDVGKNRAVACVSKLQELNNAVLVSALTEELTSEHFSKFQAVVFTDISLEKAYEFDDYCHSHQPPISFIKAEVCGLFGSVFCDFGPEFTVLDVDGEDPHTGIIASISNDSPAMVSCVDDE

SEQ ID NO: 62630 - protein, 100 aa, Sorghum bicolor
  Clone ID: 18064207.pep
ARGLDVFVVLTEDCCAGPSHDQEESNVIAILLHCIQEEMHYNVRHGAFQVLRSAVHNYPSCANMIWEKLRDNALNLLQIESFEDQKYEANFGPPGPKEES

SEQ ID NO: 62631 - protein, 199 aa, Sorghum bicolor
  Clone ID: 18064208.pep
TRGNKTRKSGLRSFMGLIGMGHGNVEKNILKPREDPLLDSDDERPESFDDDFRRKEMRRGIDLATTLERIEKNFVITDPRLPDNPIIFASDSFLRLTEYCREEVLGRNCRFLQGPETDRGTVKKIRDAIDNQTEVTDQLINYTKSGKKFWNLFHLQPMRDQKGEVQYFIGVQLDGTERVRDTAAKDGAMMVKKTADNID

SEQ ID NO: 62632 - protein, 167 aa, Sorghum bicolor
  Clone ID: 18064210.pep
HEADPPEGPNGSAVNYDMIVTHRTHAVQQSIRQITNDPRIQNAVALVENHHECRRNAEGEKVLPDGLIWRRLLLLLCYSLKMIAEIDSLSTRRASSTSFLGRFFQVPPIPYFLSSLLQSREHPRRSNEHNVGSVDSDFDLDELLNGDQEDEEDDYDQLPPFKPLSKS

SEQ ID NO: 62633 - protein, 50 aa, Sorghum bicolor
  Clone ID: 18064215.pep
TRNLLGKFELSGIPPAPRGVPQITECFDIDADGILNVSVEDKTTGEKNKI

SEQ ID NO: 62634 - protein, 40 aa, Sorghum bicolor
  Clone ID: 18064235.pep
KSIYSEVRTCQMDKQISSMQQMLWINYWAFDKQNNINATK

SEQ ID NO: 62635 - protein, 48 aa, Sorghum bicolor
  Clone ID: 18064247.pep
QLNENWRHYYINVHNHHTFRTKIVLVAELNQVLHVIHHLRYVQAAYIS

SEQ ID NO: 62636 - protein, 108 aa, Sorghum bicolor
  Clone ID: 18064249.pep
TRSEYNCTVTVVATPLDEVNITFSPPISIPLRKMQHTHATFVRGLLNPVYFGLNSASNIPELIGTLELPDIPFSCISVLKRYSEDDMVYKMFSRAKLDDGLLDQIFSK

SEQ ID NO: 62637 - protein, 81 aa, Sorghum bicolor
  Clone ID: 18064256.pep
LPASPRVRPSRGYQSGLNCTSKSRCFIFFECLLCVVPSIQRTMLGIRTQMRWMVQEWIFYCCLQKETRWDSDPKPHRYQEF

SEQ ID NO: 62638 - protein, 154 aa, Sorghum bicolor
  Clone ID: 18064261.pep
TRVHLAVGDQVPADGLFISGYSVLINESSLTGESEPVVINEDNPFLLSGTKVLDGSCKMLVTAVGMRTQWGKLMAAITESGDDETPLQGKLNGVANTIGNIGLFFALLTFVILSQGLVAQKYADGLLLSWSGEDVLEILEHFSIAVTIAVVAGP

SEQ ID NO: 62639 - protein, 209 aa, Sorghum bicolor
  Clone ID: 18064263.pep
HEAKVYLGLGSIRANSQYLKDLRQRIREVQKVLGDASKDSDLLKNANEKVKALEQMLIKGKQMQDDCSIVVKKLRAMLHSAEEQLHAHKKQTVFLTQLAAKTLPKGLHCLPLRLANEYFSLDPVRQQFPNQQKLINPKLYHYALFSDNILATAVVVNSTVLNAKHPSDHVFHIVTDKLNYAPMRMWFLSNPPGRATIEVQHIGEFTWLN

SEQ ID NO: 62640 - protein, 189 aa, Sorghum bicolor
  Clone ID: 18064274.pep
ARGRDSNPIIDEEQQVKEPSKDDSTEIISEAEVKQTPESFEHPAPSELQLEIAEVNINAPKEAIEVENSEPEDGWQPVQRPKSAGGPGKQMKHYRPTTRKVYEPDSHDPTYTSQYKARNSYSNNRYYFLRKRTVVPTTYTDPQQHVKVQTSGARFGRKIYKAVTYRVKPETATTEVLDTFKSKEQMSGK

SEQ ID NO: 62641 - protein, 209 aa, Sorghum bicolor
  Clone ID: 18064279.pep
TRLDIYKDFNKLPSADPCHGHNQITAGASDQSGRISKKRKEMHSDEEDDGEENDFQEGDEPSAAKKPRVVWSVELHRKFVAAVNQLGIDKAVPKRILELMNVEKLTRENVASHLQKYRLYLKRLSAVASQQASIVAAFGGRDPAFLHMGAFEGLQSYQPFAPCAALSSFSPHGLLGRTSAATFGVPELAPAMTVQTATNNGIISHCAGD

SEQ ID NO: 62642 - protein, 169 aa, Sorghum bicolor
  Clone ID: 18064282.pep
HEAWFAKPKVISPVNCARRGWTNIEPDVITCEACGARLLFSTPSSWTTQQVEKAAAVFSLKLDTGHKLLCPWIDNICDESLALFPPTPPPVLVGNYYELLASLMRLLALPRISCSSLETMKKRSPQLEQFLSEPFSSSVVLKGRFMLTEDSTIKDLDDAFQDADTYYQA

SEQ ID NO: 62643 - protein, 32 aa, Sorghum bicolor
  Clone ID: 18064285.pep
DSSKIRCQEFLVLVKTTRAYIFLEANAFSQTQ

SEQ ID NO: 62644 - protein, 87 aa, Sorghum bicolor
  Clone ID: 18064301.pep
TRLQQQFYHIFCKQHLWPLFHYMLPVCHDKGELFDRSLFQAYVRANKIFADKVVEADNSYDDCVWVHDYHLMLIPTFLRNKLHRITS

SEQ ID NO: 62645 - protein, 152 aa, Sorghum bicolor
  Clone ID: 18064311.pep
TRITVTGVTQGTVSQNLVDGHEKSEGPTKSPRPHCSLYTDEDIERMKRRIEELELLNADLKQRLEEAKLQLKFNDAITHPKNEIPDGLNICHGIFICSNESGYEKLEKKLAHADSKIIHVVSVHGRTIWLNVRRSRYGRQARKKDRSSPEFD

SEQ ID NO: 62646 - protein, 46 aa, Sorghum bicolor
  Clone ID: 18064312.pep
SLRRIIYIVTPIVAFKLSIFAIIKYNIKSSNPINLHPNYPCIFLLT

SEQ ID NO: 62647 - protein, 135 aa, Sorghum bicolor
  Clone ID: 18064317.pep
TREGGADGDGGCCGVGDTSPGTIVWVRRRNGSWWPGRILGPEELPPSQIMSPRSGTPVKLLGREDASVDWYNLEKSKRVKAFRCGEFDACIEKAEATQGTVVKKREKYARREDAILHALELERKQLASKYQTQGF

SEQ ID NO: 62648 - protein, 173 aa, Sorghum bicolor
  Clone ID: 18064324.pep
ARGDESLVPPPVLAALDIVRQGADVMPRKQLNSVLDAELGPDWSSKLRSFDYEPLAAASIGQVHRVVLKDGSDVVMKIQYPGVADSIESDIENVRLLLTYTNLIPKGLFLDRAMKVAKQELARECDYVLEASNQKRYKELLCDSDGYYVPKVIDQLSSKKVLTSEFVPRVPID

SEQ ID NO: 62649 - protein, 181 aa, Sorghum bicolor
  Clone ID: 18064328.pep
TRAISSPAAFRPRVNATLAYSSSVELGRPVLQGLLAVDIIAKEVLGWVQLMPNYATELVEYVRTFLERAHERCRASYMEAVLEKQSYILLSRNDVESLMRLEPANISLQNSTSEHDNNVTDAEAVEVEIELSDLLLDMCPIKQENLIHDDQKLILLASLSDSLEYLADSVERLGESFISPP

SEQ ID NO: 62650 - protein, 183 aa, Sorghum bicolor
  Clone ID: 18064329.pep
ARGNKEPKIADLGSSRLGASIETQESGTLKGVTLRYTPPECKNGGNNVSIKFDVFSLGVIILDIVAGQNGYSRRSDMRHQVFIELVSAKWKGRLKATSSSLSHELDIQRLETCVEIGLRCTEDDPNDRPAIKDIVCQLEELEAKCRNKMPLASEYQSRDFQNKYFPKEENDGPSHKKSDWTPA

SEQ ID NO: 62651 - protein, 193 aa, Sorghum bicolor
  Clone ID: 18064330.pep
HEGHQAGFQGAVYIDCPMKPCFLCKMPGHTTLTCPHRVAMEHGVIPAPRRNTNTSLDYVFQSQVKGKISMVKPKFLIPNQLECGNIKFHQRRVTCLEFHPTKNNVLLSGDKKGLLGIWDYVKLHEKITYDSVHSCILNSMKIDTTNDGMVYTASSDGTISFTDLDTGIGSPLLNLNPNGWNGPSSWHMIYGMD

SEQ ID NO: 62652 - protein, 191 aa, Sorghum bicolor
  Clone ID: 18064340.pep
ARGSFVLSLRVRVLFDNAKWAYPGGFSEEKQKVRRRKTASWLREQVLQLGPTFIKLGQLSSTRSDLFPREFVDELAKLQDRVPAFSPEKAKVFIEKEMGCSIDVVYKEFEERPIAAASLGQVHRAVLHNGERVAVKVQRPGLKKLFDIDLRNLKLVAEYFQRSETLGGPSRDWIGIYEECSRILYEEIDYI

SEQ ID NO: 62653 - protein, 176 aa, Sorghum bicolor
  Clone ID: 18064352.pep
HEVQQALYWHIEARVVLDLQEIHDSINGRELHFSMVDGDFKKFEGKWSIRSGPRSSSAVLLYEVNVIPRFNFPAIFLEKIIRSDLPVNLGALACRAEKIYLENQSCGSRKFSVEDLKPSSTSSQLDNFRSRTVDTSSSKFKEAPPTSGVNRVLPSPASELISKWGVYGNVCRIDKP

SEQ ID NO: 62654 - protein, 67 aa, Sorghum bicolor
  Clone ID: 18064362.pep
ARGLPLPTRSPLLAFMEACSRLLWMGIYMHTNCVPVLQQTLAACPYLFAIDLAASFLVFIDVHIVMN

SEQ ID NO: 62655 - protein, 134 aa, Sorghum bicolor
  Clone ID: 18064368.pep
HEDFSNLRKTLGPGIDGWEVSLKGMMSIVVLLGLVITSIYWGVNKFVLNDPSLPKSDRKKKKEKPKLGMKESLKVLLSSRYVRDLATLVVAYGISINLVEVTWKSKLKAQFPSPNEYSSFMGDFSTATGIATFT

SEQ ID NO: 62656 - protein, 74 aa, Sorghum bicolor
  Clone ID: 18064386.pep
GFNNYHWSYCVLRGNKLESLMCFSVAHSVLYVANSEDGISYHAFIAFSNRVCIPMSNIPHFAYNCMASGFSIVG

SEQ ID NO: 62657 - protein, 79 aa, Sorghum bicolor
  unsure (1)..(79): unsure at all Xaa locations
  Clone ID: 18064388.pep
ARGEGNTFPDEQYGYPKAESERWVSCIRILDPRSRDTTCLLEXCRXNEAAVSICTVNFHDKEHGTLLAVGTAKGLQFWP

SEQ ID NO: 62658 - protein, 99 aa, Sorghum bicolor
  unsure (1)..(99): unsure at all Xaa locations
  Clone ID: 18064404.pep
ARGILKKRKRTVRPEARKEPPKRPQLVEPSANVPRQIVDEDSPEVFRCLSCFTFFIPTGCSFNIFRISERRDVNQQVQVQHSSASXQTSEHCGSWLLSC

SEQ ID NO: 62659 - protein, 132 aa, Sorghum bicolor
  unsure (1)..(132): unsure at all Xaa locations
  Clone ID: 18064443.pep
EFRSNHIVLIIHISKSFPHLLVGAGVESVTLSGGDKSLLLVIGDGVDTNKLLKKLKKKVGEAEMVELRTHDTXRGGGAPAPAPGHQAGAGGHDGDGGGAVALQQPPAAVAAQLRRGAHQPVLLPLRLPVAGG

SEQ ID NO: 62660 - protein, 181 aa, Sorghum bicolor
  Clone ID: 18064446.pep
MMDKYARLMQKLEIVNVELFKGISQLFGIFYHYIYETFGNLDKSQSSKPLPDHQSSRLKAALSKITQDSDQWTKPNNVSYSPSSPLSMNSTFGQMDVMPTAPPSSMFTSYGLKERCAAAETLSLVARVLNRSRAHLHSVLSKNNSSVVEEFFRTLVDSVPDLTEHIHRMSARMLLHIDGYP

SEQ ID NO: 62661 - protein, 83 aa, Sorghum bicolor
  Clone ID: 18064452.pep
LAAGNPPPKPWERAGASSGSVPFKPPSGGSTSDVVEASGTAKHGEVVSAAGNNVASNVNSNISTPVPPRPWQQQGYGNSYGGN

SEQ ID NO: 62662 - protein, 70 aa, Sorghum bicolor
  Clone ID: 18064468.pep
TVHSYFDAAYGVRIGMASLHHKLVHYMQTIPSPKNTAPQVHVICSLETHANLNTTNLHPRTSHSLTSHID

SEQ ID NO: 62663 - protein, 80 aa, Sorghum bicolor
  Clone ID: 18064482.pep
ARGALVAVSSGQLDQCGVISKTGRHISNTGGAPKLTRSRMSVCPRGYVSPQPEIVRSTLRFVVHPCNYVTFYSPIPLTGP

SEQ ID NO: 62664 - protein, 90 aa, Sorghum bicolor
  Clone ID: 18064484.pep
TRVLAVSHVFFCATTMLLGGAKIHKWKKWEEEIQKNAAGNGSKKVLPMHQVSFIREHYEVIGTDSKTLCWLVRCTTFMCSTVIYYLYIEK

SEQ ID NO: 62665 - protein, 188 aa, Sorghum bicolor
  Clone ID: 18064493.pep
ARGKKLQRLREFVRSEYDHSCLRSCRSRALYEGLKVTATPDLMLGYLDFFLGGDEKRPDLPPRLRQRFPMSLIFGGDGSYMAPFSLNSDSVLTSLMSQAVPSWIWHRLVAGLNAQLRLVRCGNLKVTFLPVIDWLETHANPSLAENGIRVDLAWFQATALGYCQFGLLVYAVEGEAALTEPDGSPRVK

SEQ ID NO: 62666 - protein, 170 aa, Sorghum bicolor
  Clone ID: 18064500.pep
ARGSSCKSWLSVNGSVQSMSAEKHDEFKKSIEDMAANSLRCVAFAYCSFDTEMIPEEDIASWELPEDGLTLLGIIGIKDPCRPGVKDAVRLCTTAGVKVRMVTGDNIETAKAIALECGILDANSVISEPVVIEGKVFREMSESARGDAADKIIVMGRSSPNDKLLLVQAL

SEQ ID NO: 62667 - protein, 201 aa, Sorghum bicolor
  Clone ID: 18064501.pep
MLLVSLLLLLLSSPKLLAEGPFCSNANTACMPSSTYMSNLKSLAEDLIGSITSSNSHSAHGAAGTGAGRVYGAVLCRGDTNPGKDCARRLEALYAAISNSSSSCSSQKNINLFDDRNRTQLIFSDQDFSSSNAQECVVSGNLNPPPVSDDADSEFDVPLSKLMNQLADDMVSKSVSRYETGQGWLPQTNQTVYGLVQCTDD

SEQ ID NO: 62668 - protein, 58 aa, Sorghum bicolor
  Clone ID: 18064506.pep
SNCLNCLFLQCIPSIIGDSIPMKEIVFITYVIVDGWTGIAGDIEVIFFHLKNMLVSKL

SEQ ID NO: 62669 - protein, 106 aa, Sorghum bicolor
  Clone ID: 18064512.pep
HEEKKKWMATVVSSRAADSLPPAASPRQAGERAVLLFLSSLLVAVVEAHARAVDASKVVETWGAPDASFTSIAASLADRAADPGLGCGEEEHRGEYLLRVHLGDFV

SEQ ID NO: 62670 - protein, 135 aa, Sorghum bicolor
  Clone ID: 18064517.pep
YNIIYLLQILDYGFDRLGANSEVGHPILMTECECNPSFSRARMSELLFETYGVPSIAFGIDNAFSYKYNQKLGNCNEDGLAISCEHGTCHVVPFLKGQPVLGACCRTNVGGFHITDFLRQLLSLKYPYHMASITW

SEQ ID NO: 62671 - protein, 81 aa, Sorghum bicolor
  Clone ID: 18064519.pep
DEEYQKVAIVIKEITVASCIVHTCILLNQYYQDTNPIIFSLMFSSLLQWNYCNHSLTLDVNLEETTVIQPKRIHNKNAKTL

SEQ ID NO: 62672 - protein, 175 aa, Sorghum bicolor
  Clone ID: 18064534.pep
ARGSSVRKGKRSINWRADKPSTLYWVETQDGGDAKVEVSPRDIVYMENAEPINGEHPEILHKLDLRYAGTSWCDESLALVYESWFKTRKIRTWVLSPDKKDVSPRILFDRSSEDVYSDPGSPMFRRTAMGTYVIAKIKKEDGNTYVLLNGMGATPEGNVPFLDLFDINTGSKERI

SEQ ID NO: 62673 - protein, 157 aa, Sorghum bicolor
  Clone ID: 18064547.pep
TRADRKYAHTFKYKGVEIGVVVSYAVLIHPDTAASISVGNLQLVTVSPKSSKKGLAPKGKEVGQKKGIPVTKERAHEAIVYILLSDSVAKGHVMLPYSIRHFISADVHSWVYIKTYSANIKEDEPLVTISPLQFKMRVKDAHGSSKLVSQEADTSRI

SEQ ID NO: 62674 - protein, 139 aa, Sorghum bicolor
  Clone ID: 18064558.pep
ARGYAEEHGYGAKLKVRNSLIAMYSRCGCVDKAYRVFCGTPQKSVVTWSAMISGLAANGFGDDAISAFEEMIRSDVAPDEQTFTGVLSACSHSGLVDEGFRFFDMMRCEYGLKPNVRHYGCIVDLMGRAGLLDEAYELV

SEQ ID NO: 62675 - protein, 124 aa, Sorghum bicolor
  Clone ID: 18064565.pep
TRDYCMQAIAKSGFVEPTPIQSQGWPMALKGRDLIGIAQTGSGKTLSYLLPGLVHVGAQPRLQQGDGPIVLILAPTRELAVQIQEESTKFGSYSRTRNTCVYGGAPNGPQIRDLTRGVEIVIAT

SEQ ID NO: 62676 - protein, 175 aa, Sorghum bicolor
  Clone ID: 18064570.pep
ARGLDNVCTLYAEDCMKKRLCALCLCDIGDRLASRCVTCQDWYHDSCMENLPAITQMTVEWMCSFCSLLQSEDQLENQIPVKMFKGNCPALTALDELISSAKGLYTGIEEMNLLKEIVEKARILNAYLMQILDDSDSYHGEDLTVIFKSLLVALKATSASGLYDHYISCRIESVL

SEQ ID NO: 62677 - protein, 174 aa, Sorghum bicolor
  Clone ID: 18064573.pep
HEAGAYIFRPDGNTPTIVSSSVTLKVIRGPLFDEVHQQFSSWIYQITRLYKNKEHAEVEYTIGPIPVDDDVGKEVITQLTANMSTNSTFYTDSNGRDFLKRVRNYRKDWNLQVTQPVAGNYYPVNLGVYIADNKYELSVLVDRAIGASSIQDGQLEIMLHRRLLNDDGRGVAEP

SEQ ID NO: 62678 - protein, 149 aa, Sorghum bicolor
  unsure (1)..(149): unsure at all Xaa locations
  Clone ID: 18064585.pep
ARGLDQSSAVHDMFFPELNTAVDPINGGNDSMYFYYPGRIWLDTDGKPIQAHGGGVLYDKRTNTYFWYGENKDGKTYKAHSKGADRVDIIGVSCYSSKDLWTWKNERLVLRGEEKNVTHDLHKSNVLXRPKVIYNDRTGKYVMWMHIDD

SEQ ID NO: 62679 - protein, 180 aa, Sorghum bicolor
  Clone ID: 18064598.pep
HEGPRDLHANRLDGTIPPELGKLGSLLELRLSNNSLTGIIPASNDSDMGSVNSNDQIGLCQLSPLTNIDLSYNFLVGDIPSCLQQIQRYTFAFCDLKVSVVFLHLPVLQYLNRSSLVGNCFQNNTSNRPLQQCDTNQDRGEDNGADENAQKGLPEPLWLFILEVIAALSLLCLLTLCTMT

SEQ ID NO: 62680 - protein, 200 aa, Sorghum bicolor
  Clone ID: 18064600.pep
HEAVVAVEAFRAYKEKVANLTGVTRKFMGNLVKAFKTNLPEVVVTPAAFDFDHIVNGPTMGSQTAGVGGIISTATVTLEQPAMEPMVSGSAGFWHSALQQPSSSSLISQEANIANDSVQEHRPIRSPVQHPVRPGRHGGLLSNPSQFQPIHSTFFGEATTSMGPPNIGAITPLQFNMSNMISSGATSTPLVTFSMSAPGQ

SEQ ID NO: 62681 - protein, 180 aa, Sorghum bicolor
  unsure (1)..(180): unsure at all Xaa locations
  Clone ID: 18064637.pep
HEAIRHLSVSSDSDTVAQLKSRCDLKRLRTLLILKNPSSSLDQLPGDFFTELKGLRVLSLEGCNIIRLSERIGNLKYLRYLALCKSITKLPQALTKLYRLQTFSSPKGSGLEVPEHIVNLTRLRHLDMDTSKITGIGKLVHLQGSVKFHVKNEEGHTLGDLDGMSSLRXELHIKNLDVVT

SEQ ID NO: 62682 - protein, 140 aa, Sorghum bicolor
  Clone ID: 18064639.pep
ARGRNAMRALQNKPLRRRKLDIHFSIPKENPSDKDLNQGTLVIFNLDPSVSNEEVRQIFGAYGEVKEIRETPNKKHHKFIEFYDVRAAEAALRSLNKSEIAGKRIKLEPSRPGGTRRNFMQQLGHDLDQEEPRSYRHSHV

SEQ ID NO: 62683 - protein, 124 aa, Sorghum bicolor
  Clone ID: 18064658.pep
TRRRSYGSLLDLKQLVSEKDLIVREEACRVGLLFGGFTGSYHALRCFLRRFRKKETPYNAILAGSVAGLAILALDDSSKRRTLSLYLLARLAQCAYNSAKSKNKFHFWGSHWRHGDALLFSLAC

SEQ ID NO: 62684 - protein, 86 aa, Sorghum bicolor
  Clone ID: 18064669.pep
ARGWIFVLNTNRSLYVGQKRKGKFQHSSFLSGAVTSAAGRLVIQEGVLKAIWPYSGHYLPTEENFREFITFLEENNVDLANVKRCS

SEQ ID NO: 62685 - protein, 200 aa, Sorghum bicolor
  unsure (1)..(200): unsure at all Xaa locations
  Clone ID: 18064672.pep
HEAAALGSPECSGTAMAMRSAARQAILSPPLGQRGPGPFLCGRSLPVAPRVEPCRASSSATAPAAGKHLPPLFSVAPMMDWTDNHYRTLARLISRHAWLYTEMVVAETIVHQKDNLDRFLAFPEEQHPIVLQIGGSNLENLAKATELANDYSYDEINLNCGCPSGKVAGHGCFGARLMFEPXGDAMSTIAANCDVPVSVK

SEQ ID NO: 62686 - protein, 168 aa, Sorghum bicolor
  Clone ID: 18064677.pep
HEEKPHRIYVPRDEAFEELKQGAFSSGRLRAVLHTLIPSMIATISAETHSFQGFHHVDNLYKEGLRLKLGLQEHLFQKIPLVQKIQESSEGMLRYDTPRILSKDKFAWLRDDEFARQTVAGINPVSITRLTVFPPVSKLDPAIYGSPESSITEAHIAGQLNGLTVQQA

SEQ ID NO: 62687 - protein, 37 aa, Sorghum bicolor
  unsure (1)..(37): unsure at all Xaa locations
  Clone ID: 18064683.pep
KQSSNDKNITTRETDGGPGRMESGEHHILARKRGERX

SEQ ID NO: 62688 - protein, 143 aa, Sorghum bicolor
  Clone ID: 18064684.pep
ARGNHDGTAMIISWVTTSEPGSSTVIYGTSEDNLNYTANGKHTQYTFYNYTSGYIHHCTIKKLEFDTKYYYAVGIGQTVRKFWFMTPSESGPDVPYTFGLIGDLGQSFDSNVTLTHYESNAKAQAVLFVGDLSYADNYPYHDN

SEQ ID NO: 62689 - protein, 125 aa, Sorghum bicolor
  Clone ID: 18064691.pep
MATAIVSAAFSLVGKALSPLTDGLLKDWAASVELGDNVEALEQELLAVQALLEHTIGKEIVDNSALKKMLLRLQDLGYDADDVLDELDYFRIQDELDGTFDAADKHAKGVTHNLAFNVRHTAKAV

SEQ ID NO: 62690 - protein, 147 aa, Sorghum bicolor
  unsure (1)..(147): unsure at all Xaa locations
  Clone ID: 18064695.pep
HEDLMILNTLAGRSYNDLTQYPIFPWILADYSSEKLDFNKSSTFRDLSKPVGALDAKRFKAFEDRYLNFVDPDIPSFYYGSHYSSMGIVLYYLLRLEPFTALHRNLQGGKFDHADRLFQSIESTYRNCLSXTSDVKELIPEFFYMPE

SEQ ID NO: 62691 - protein, 181 aa, Sorghum bicolor
  Clone ID: 18064705.pep
ARGEFAWSRRAHDRPPLVGTMFRMLKNFDRLFDEQVEYALAHRTSRLLFPNPGHSELWTSDPQVIEHILKTSFSKYSKGDFNTQIMNDLFGNGIFATDGEKWRHQRKLASHELSTRVLRDFSSGVFRTNAAKLTEVVSSAATNRTSIDMQDLLMKTTMDSIFKVGFGFELNTLSGSDEPSI

SEQ ID NO: 62692 - protein, 194 aa, Sorghum bicolor
  unsure (1)..(194): unsure at all Xaa locations
  Clone ID: 18064714.pep
TRLRKKMALARRNSAVNRKQENLVKSLRLKKCISSIKAVKTHPIEELQGKIQLKGNMNLSPDIVLALGVSGTGRTILSPDRPVSIGTKRGSSTKVLACKKLAKRRGSKELCSPNNSLDVTRTVQQRGSKEVAEPMEECPLAFECLNSGTQEKLDRTLEDAQNITELSNQDLFPLVPPGFKSMDNGXGTNIHDTQ

SEQ ID NO: 62693 - protein, 163 aa, Sorghum bicolor
  Clone ID: 18064720.pep
TRVTLSLAFAMKQLMNDKALVRHLSACETMGSAGTICTDKTGTLTTNHMVVEKIWISEVSKSVTSNNSLEDLTSAISPATLSLLLQGIFENTSAELVTEKDGKQTVLGTPTERAIFEFGLKLEGLDAEDRTCTKVKVEPFNSVKKKMAVLVSLQNGMYRWFTK

SEQ ID NO: 62694 - protein, 172 aa, Sorghum bicolor
  Clone ID: 18064755.pep
TRLSLEHFVSSYNKASRRAIFLDYDGTLVAQSSINKAPSEEVISILNTLCNDPKNVVFIVSGRGRDSLDEWFSPCEKLGVAAEHGYFIRWSKEAAWESSYSSPQQEWKHIAEPIMQVYTETTDGSSIESKESALVWHYLDADHDFGSFQAKELQDHLERVLSNEPVVVKCGH

SEQ ID NO: 62695 - protein, 139 aa, Sorghum bicolor
  Clone ID: 18064763.pep
ARGGSLQSLRNMLMALQKENSSLKIEKVKLEADLKSMKSTSQKTVDSALDTNNKISDSEKVKEEMDSLKRALQDASRERDKAVQDLARLKQHLLDKDLEDQEKMDEDSKLIEELRVVCEQQRAHIMQLERALKVEMAKQ

SEQ ID NO: 62696 - protein, 152 aa, Sorghum bicolor
  Clone ID: 18064764.pep
MEIRSSQIKGVTLLKVLSKYNRQTCLNFVNHGVFQQALWHWYRKAGTIEDWVRSGKEKCKLSSAMMVEQLRFWRTCISYGFCIAHFADFFPVLCLWLSPPEFKKLNEHNVLVEFSSIARESYLVLAALAQRLPLLHSVEQLANQDRGVSASY

SEQ ID NO: 62697 - protein, 179 aa, Sorghum bicolor
  Clone ID: 18064766.pep
HEGTAAGGGRGAPQRQLGRRKMGSTGGNCKRWWDHQDRDCKNNEKMRFHVVADEDSRSFMRIPQEFGSYLRKIISDTIKLNAPNGCTYDIAVCREMGEIVLRSGWDVFADAHNLEQNDYLVFKFCGSSSFKVHIYSSCGGSQKITSCVNPDPEILEDVPPCTTSDHHVPGNEIPHPGHV

SEQ ID NO: 62698 - protein, 187 aa, Sorghum bicolor
  Clone ID: 18064780.pep
TRHQLVIWRWDVHISMDIIGHWLDLLNSDGWIPREQILGAEALSKVPEEFVLQYPSNGNPPTLFLAIRDLASGIHAQQFSDEEAEKVSSFLERAYIRLNSWFQWFNSTQSGKYEGTFYWHGRDSITRRELNPKTLTSGLDDYPRASHPNDEERHVDLRCWMLLATNCIRSIAEFLKMDSSLEKDYYK

SEQ ID NO: 62699 - protein, 162 aa, Sorghum bicolor
  Clone ID: 18064806.pep
HEADITPDREAPELIRGLVLHALGEVSSRVKEMNLVDMLTRDMADLIGNHLDIFRKNQTLIGVDVMRTLSSEERDERLKQHLIVSQELHPALLSSEHEYKVLQEIVGGIMALVLRPQDAQSPLVRCFSRELMTCLVLQPVMNFASPVYINELIVYLLNNKDT

SEQ ID NO: 62700 - protein, 109 aa, Sorghum bicolor
  Clone ID: 18064810.pep
ARGDLIRGMSCEADTVIWGALLTACKNHSGIEIAERAAVEMLKLDPSNHGVYVVLSNLYAEAGRWQDVDKLRKEMKGARLSKIPGASTVNGDGSLEQPESPPPQGNVLV

SEQ ID NO: 62701 - protein, 101 aa, Sorghum bicolor
  Clone ID: 18064827.pep
ELCYAAVQPSMSYASSACPHSKRETTVVRGQNEILCNCSSRLLAAVAPSLPFVPSNRATEFRRSTSFARLSAQQHGLLTRKEQPATFLFFGAMLSEGWPRA

SEQ ID NO: 62702 - protein, 163 aa, Sorghum bicolor
  unsure (1)..(163): unsure at all Xaa locations
  Clone ID: 18064829.pep
MDEQWSYHSSHSASVSSGQYSVKKSTVKEVQDRQHCQPQGVAYFTDLSEKEIERRRKIGAANKGKVPWTKGRKWSEEHKKLIKQRTAEALRDPKVMSXRKKMLGHRQLHRQTSKDKISAALRTIWERRIVSVQSRQKVLQIWSNSIAEAAKNGDHSQNMLHWD

SEQ ID NO: 62703 - protein, 137 aa, Sorghum bicolor
  Clone ID: 18064849.pep
HEGSVGLRDCKALEKMVKTHAENGGLYGAICAAPAVTLAYWGMLKGLKATCYPSFMEKFTAEVIPVDSRVVVDRNAVTSQGPGTAIEFGLALVEKLYGKEKMEEVAGPLYVRPQHGAEYTVEELNSAEWKCSSTPQV

SEQ ID NO: 62704 - protein, 163 aa, Sorghum bicolor
  Clone ID: 18064862.pep
HEGGLLELRHTLEKLVCFNSTDALRHVFASRIMDIKDSPVWSKLSYVSCASNGVVLMDESLQLLPAIETLDLSRNKFAKVDNLQKCTKLRNLDLGFNHLRSISSLSEVSSRIVKLVVRNNALTTVNGIENLKSLMGLDLSYNIISDFSELEMLGTLSLLQNLW

SEQ ID NO: 62705 - protein, 183 aa, Sorghum bicolor
  Clone ID: 18064875.pep
HEGDAGVVTRLRRAGAVILGKANPSEWSNFRPVNSGWSARGGQTLNPYVLSASPCGSSAGPGVAAAANMAAVTLGSETDGSILCPSSRNSVVGIKPTVGLTSRSGVIPIMPLQDTIGPMCRTVSDAVHLLDAIVGYDEFDAEATGAASKYIPQGGYTQFLRIHGLRGKRIGVPDVFFHGYDGV

SEQ ID NO: 62706 - protein, 57 aa, Sorghum bicolor
  Clone ID: 18064883.pep
EKCQKILFFNFINLEFDYRLDKRTLDMLLGGIWLEVLKFNRYCSIFVLSGDLYLIMD

SEQ ID NO: 62707 - protein, 203 aa, Sorghum bicolor
  Clone ID: 18064888.pep
ARGNAVTPLYSLDAEFSKPMWIFGVSSYDFLGIDDTSHKIVCCYRQNGKSYVGVLDHNSESFSKIDIPFSSVTNIVVSGDGSFYIEGASATLPVSIAKVTLDKKRTMATDFSIVWSSSEDVSQYESYFSLPEFVEFPTVVNGQHAYAYFYAPYNNVFQGLSDEKPPLLVRTHGGPTDEARGILDLSVQYWTSRGWAFVDVNYG

SEQ ID NO: 62708 - protein, 156 aa, Sorghum bicolor
  Clone ID: 18064894.pep
TRENFQPSKVRGIPDISINVAPTNATEEGSAATLELDLEHYVVPSPPTAPPNGYAANLAATPASMIQTGASWTNDILLSDGIQSPSSVSAKLEDRSNNKKNIEAWATDSSKNSGLIESKSVGTFTPLQKLDGQKGLFVDRGVGSPMLPKSASACSL

SEQ ID NO: 62709 - protein, 148 aa, Sorghum bicolor
  Clone ID: 18064904.pep
ARGKAELIPDLDIFFERLYEYFCAKGLRCIIIKWIIEILNVTFMVCAIGFFFLFVDWDALGHLKCGVEALEIGDKPCDLMSVIKNDPLVPFTYVKLITIGSMVILTTYGIINLIKFFVKLRSILNDRDFYYNSLKVTDLEIQTISWPK

SEQ ID NO: 62710 - protein, 160 aa, Sorghum bicolor
  Clone ID: 18064911.pep
FVNVRCTCTFVPSFQVAGPPAIARGALTEIASRLRNRTLGVTSTANNPPPFAPFDDPPVDMPSRKSTLYGGPANDPPYGRPAIDPLYGRPAIDPLYGRPAIDPPFGSHTNDRPYGRPAVVPPFGRPTNDPPYGRPANDPPYGRPANDPPYGRPANDPYGR

SEQ ID NO: 62711 - protein, 166 aa, Sorghum bicolor
  unsure (1)..(166): unsure at all Xaa locations
  Clone ID: 18064933.pep
MIQMSAAGIGIMEALALFLGSGLFLKLMGVSPVSPMHRPAKLFLSLRALGAPANVLMLAVQGIFRGFKDTKTPVFYIGLGNLSAVALLPLLIYGFQLGITGAAISTVVSQYIITVLLLRSLSKKAVLLPPGIDQLEFGGYLKSGGMLLXRTLSILLTMTIGTSMAA

SEQ ID NO: 62712 - protein, 179 aa, Sorghum bicolor
  unsure (1)..(179): unsure at all Xaa locations
  Clone ID: 18064936.pep
TRLHLCFLIGSSIKQTNSEYTLLLFLKSKTQRILSESMKLLAFGLVLLSFLQSFATSDYQVAALYEIRTQLSDKGGVLKDWKDNQMTPCGWAKINCQDNKVIAITLSSVGLAGILSPSIAKITTLQQLLLDGNEISGGIPEELGNLSSLTTLNLGRNQFNGSIPDSLGRLLXLQNLDLS

SEQ ID NO: 62713 - protein, 179 aa, Sorghum bicolor
  Clone ID: 18064941.pep
HEENTPAITSIPANLSTTLKDDESMSFPPRRPSPAITEIGIGRGIARGITSSQGLGTAPITIGPVPGNGSVSALPAINDLSKRNILNTDEKINSGGLSQQLVTPLGSKVQPQQVPRTNDAISSDSANPNENPILGGRVFSPPVVSGVQWRPQAAATFQNQSETSQFRGRPEISADHREK

SEQ ID NO: 62714 - protein, 152 aa, Sorghum bicolor
  Clone ID: 18064952.pep
MATAHVFLCLAAVVLAAAAAAASPAHHQHSQCLDNPPDLSLRGGESGVVVGDLPGGFKAYVTGPSESSRAVVLASDVFGFEAPILRTIADKVAEAGYFVVVPDFFNGDPYDTSKNITVWIKFHSPVKAAKDTKPLFAALKKEGKSIAVGGYC

SEQ ID NO: 62715 - protein, 207 aa, Sorghum bicolor
  Clone ID: 18064958.pep
TRARRRASIGKRVVEALEEVKELTEQGRKFRTFGLKPPPRAVSRLSQTETVGLEPMLARLHDLLEKGESNIIGVWGQGGIGKTTLLHAFNNDLEKKDHNYQVVIFIEVSNSETLNTVEMQQTISDRLNLPWNELETVEKRARFLAKALARKRFLLLLDDVRKRFRLEDVGIPTPDTKSQSKLILTSRFQEVCFQMGAQRSRIEMKVL

SEQ ID NO: 62716 - protein, 201 aa, Sorghum bicolor
  unsure (1)..(201): unsure at all Xaa locations
  Clone ID: 18064986.pep
TRVVVAALLLPPAVFAAPEEHLVTGLPGFHGAFPSKHYSGYVTVDERSERSLFYYLVLSERDPATDPVVIWLNGGPGCSSFDGFVYGNGPFNFEPGSSPGSLPKLQLNPYSWSKVSNIMYLDSPAGVGMSYSLNKSDYITGDLKTAADAHKFLLKWFELYPEFQLNPFYISGESYAXVYIPTITDEVVKGIERGVKPRINF

SEQ ID NO: 62717 - protein, 189 aa, Sorghum bicolor
  Clone ID: 18064992.pep
TRVVFRQILTTPAVRSKNSKIAFMFLTPGTLPFERLWEKFFEGHEGRYTIYIHASREKPEHVSPIFVGREIHSEKVTWGKISMVDAERRLLANALQDIDNQHFVLLSDSCVPLHNFDYVYDYLMGANLSFIDCFYDPGPHGNFRYSQNMLPEVTETDFRKGSQWFSVKRQHALMIIADSLYYTKFKLHC

SEQ ID NO: 62718 - protein, 184 aa, Sorghum bicolor
  Clone ID: 18065034.pep
TRGSLKGVLDSLEAKIQDMREFVMLLGSCPRLPRQMYCTYLFMDKCMFGRHTEKEHVINFLLCSDGTHDDCPNLGILPIIGPHRVGKKTLVQHACKDERVRGFFSKILFFKGDDLENAEFAVSLEAASGKKCLFVVEFSWNVDEAAWANFKSTFQEATGHGSKVLLIGRTQEVAKLGTAMPIWM

SEQ ID NO: 62719 - protein, 160 aa, Sorghum bicolor
  Clone ID: 18065047.pep
TRNSRGDQLLVGASLRMSYLWNSMRHLKLVHNMRAKSDPWFAEYLLRIGGGLEEANGDGEIRLPDEICIPHTREDSDLDTLIDCIFPALNANMSNKSYITSRAILSPRNDWVDMVNMKMISRFQGNEMVYHSFDSAVDDPHNYCPSEFLNTLTPNGLPPH

SEQ ID NO: 62720 - protein, 152 aa, Sorghum bicolor
  Clone ID: 18065048.pep
GGRRGQPRRRGGGRCRRGEQDPGDQGFPGGPGPGPQISHFYLVWQCYNLLTVWSPLLRCNLYLCRVVSSQSEDEMVSLLQNLADMDITYKALQDTDIGRHVNGLRKHPSSEVRQLVKLLVRKWKEIVDDWVRLHNSGGDVGGSIISDGDSPD

SEQ ID NO: 62721 - protein, 133 aa, Sorghum bicolor
  Clone ID: 18065078.pep
HEGGFVVVSIADSFAPQEIGSRMGVSKAKAIFTQDFIVRGGKKVPLYSRVVQGTSSKAVVIPAIGDSIGITLRNGDMSWKDFLSRAAGRSSSYSPVYQSVDALTNILFSSGTTGEPKAIPWTQLSPIRCASDT

SEQ ID NO: 62722 - protein, 182 aa, Sorghum bicolor
  unsure (1)..(182): unsure at all Xaa locations
  Clone ID: 18065083.pep
ARGNNGEVSHTGQDADTACAAYLHLNGFCLLMLAHDEANIILRESKVHDAIRCFFRAASGYEAPKVLQNFSLETGFQVSGESRSISLWRLNYYEWAMQIFEQHSMSEGACQFALAALELVDIIDGLDNGIEAEGLPETAAMIKGRLWANVFKYSLDLKHFRDAYCAIVXNPDDDSKYICLRR

SEQ ID NO: 62723 - protein, 142 aa, Sorghum bicolor
  Clone ID: 18065089.pep
HEGEPDPFAKAEAEEVDFEGQENTGINFDAYEDIPVETNGHDVPAPANTFAEIDLGDALNENIRRCKYVKPTPVQRYAIPISIAGRDLMACAQTGSGKTAAFCFPIISGILKSPRPQQRSRSSRTAFPLALILSPTRELSVQ

SEQ ID NO: 62724 - protein, 123 aa, Sorghum bicolor
  Clone ID: 18065100.pep
TRVNESMVTGESRPVAKRKGDTVIGGTVNENGVLHVRATFVGSEGALAQIVRLVESAQMAKAPVQKFADHISRVFVPLVILFSMLTWLTWFVAGRLHSYPHSWIPQSMDSFQLALHVGISVMV

SEQ ID NO: 62725 - protein, 117 aa, Sorghum bicolor
  unsure (1)..(117): unsure at all Xaa locations
  Clone ID: 18065108.pep
MADAAAPGLLPVAADRDRERDKDKDDRRRWAARCGFAVLGIMSTLLVYGVLQEKIMRVPYGVEKEFFRYSLFLVFCNRITTSMVSAMVLLASKKSLDPVAPLHKYGIVSISXILTTT

SEQ ID NO: 62726 - protein, 133 aa, Sorghum bicolor
  unsure (1)..(133): unsure at all Xaa locations
  Clone ID: 18065110.pep
ARGSHLSVILSQDAFSAGPASNTEEMRELQELQRTLYTFLHAMATHDLSTVLLTPSSRQYLETIMQLLLFTSCKHKDILLRKACVQIFVNLVKDWCXYSEDKLPGFRVFMIEKFATNCCLYSVLDKSFDLRDA

SEQ ID NO: 62727 - protein, 100 aa, Sorghum bicolor
  Clone ID: 18065121.pep
TRAIAIGKRSTEKLFRILGMYEALAEVLPELEGLFSGEAKDFIKEEAEGILARLGDAVRGTIEEFANAIQGETSRRPLPGGEIHPLTRYVMNYVRLLADY

SEQ ID NO: 62728 - protein, 93 aa, Sorghum bicolor
  unsure (1)..(93): unsure at all Xaa locations
  Clone ID: 18065125.pep
CLGPLGNPDPTDLINVETNRIPFRAENFSLDLWKDAFXLGPAPSRDXKDWFLRIGNSYEVQRGERKLDQCIRLSIADMERNESLLIAASYFLG

SEQ ID NO: 62729 - protein, 37 aa, Sorghum bicolor
  Clone ID: 18065143.pep
CFFINYNLISLNMITRLVAFIYSIFQNYKCLIGLSDI

SEQ ID NO: 62730 - protein, 51 aa, Sorghum bicolor
  Clone ID: 18065148.pep
VKNRRATADLSGHLANLRTKCSTLEERCVSISQELDHVRHECTDWRVKYEQ

SEQ ID NO: 62731 - protein, 101 aa, Sorghum bicolor
  Clone ID: 18065152.pep
ARGLNPSDRTAINDEIITDLVTECRSNQQKLLQFVSSSGNEQLLKQGLEINDLLQSVLAKYDAVASGAPLAVEAPVREAIEAPMEAPAVKPSAPPEHNDNV

SEQ ID NO: 62732 - protein, 56 aa, Sorghum bicolor
  Clone ID: 18065157.pep
HSRKYRFNLAVWFSTQEYAFSWVFYTTLKVIVYPWGFNFAPQGNCWPSRILSFLVV

SEQ ID NO: 62733 - protein, 111 aa, Sorghum bicolor
  Clone ID: 18065164.pep
ARGEQDSFPVVPPGCSDDETSIQQFINEAKAALVSVGIIRDAFIYNGKDPGKLSGRIVDSDMHDVARFLNRLLGLPPNIQNRLFDLFTSILDIVLHNARIEGQLDSGIVDI

SEQ ID NO: 62734 - protein, 95 aa, Sorghum bicolor
  Clone ID: 18065166.pep
TRRNLKSQLPHSRMLAISALNTLLQGSPHKASAQDSKQSVDHPEDCNISSTEEILNEIIREEGFMNETLNSLSHVHIISDNDGSSKASYGGVIFS

SEQ ID NO: 62735 - protein, 54 aa, Sorghum bicolor
  Clone ID: 18065167.pep
DYNLYVEAKCGNIPPINIKKDKMNEPESRHCINTRFTIGNVSIRDSQQTVDMVS

SEQ ID NO: 62736 - protein, 190 aa, Sorghum bicolor
  unsure (1)..(190): unsure at all Xaa locations
  Clone ID: 18065171.pep
TRKEQELEGTFRFMHSRLRTHAESIAFFGGGSREKAMIDAKFTTLLNHSKVLLRKKWLYGIFDDFVTKQLPHNVTWGLSMLYALEHKGDRALTSTQGELAHALRFLASVVSQSFIAFGDILELHKKFLELSGGINRIFELEELLQASQSNPVVPSDAINATSEEIISFRGVDIVTPSQKLLASXLSCDVS

SEQ ID NO: 62737 - protein, 143 aa, Sorghum bicolor
  Clone ID: 18065188.pep
MSRGRRGIFDGLPIPADKSYLKEGLLRIDESWAAARFDSLPHVVHILTSKDREGEIQFLKEQSDLIEDVVDEVVHAYHHGFNKAIQNYSQILRLFSESADSITGLKGEMEEAKKLLGRKNKHLGQLWYRSLTLRHVLSLLDHV

SEQ ID NO: 62738 - protein, 43 aa, Sorghum bicolor
  Clone ID: 18065189.pep
QFTDEEIEQSYEEFYEDVHTEFLKFGELVNFKVLCASFCPETT

SEQ ID NO: 62739 - protein, 70 aa, Sorghum bicolor
  Clone ID: 18065193.pep
CGPLLGFKRSTLTLFASIETSLRTNQWILHTVLAYNLFELVMPEKVGCKNLLECACIDMFINKVNYFSKW

SEQ ID NO: 62740 - protein, 208 aa, Sorghum bicolor
  Clone ID: 18065195.pep
ARGSFFRERGVEPTWTPHSLDEQMQWFKKLLPSIASSETEQKEIMSKSLFFVGEVGGNDYNHLIVRQKSLDELHEVVPNVVGAISSAIVDLINLGAKKLVVPGNFPIGCVPLYLAIFQSQKEDYYEEQTGCIKWLNEFAEYHNRMLQEELEKLRNLHPDVTIIYADYYGAALNIFRAPLQFGFTVPLNSCCGSDAPYNCSPSILCGRP

SEQ ID NO: 62741 - protein, 65 aa, Sorghum bicolor
  Clone ID: 18065198.pep
NPTTSQKIRLQSYTLKVLRKCKIRNMKLFSWITKTKVDTEGCYCYCYLTYRACSLIIKAHAKPTF

SEQ ID NO: 62742 - protein, 166 aa, Sorghum bicolor
  unsure (1)..(166): unsure at all Xaa locations
  Clone ID: 18065203.pep
MGGASNSNLLPPGFHFFPSDEELVVHFLRRKASLLPCQPDIVPTVCMNHYDPWELNGKALGAGNQWYFFSHAKHSRVTPNGYWSSVCADETVSSGGCSVGLKKTLVFSTGEPSESEGTETNWIMHEYHLLDGRKGISSSTTSTNSSSKKLHHPNTESNNXVICRVF

SEQ ID NO: 62743 - protein, 174 aa, Sorghum bicolor
  unsure (1)..(174): unsure at all Xaa locations
  Clone ID: 18065208.pep
TRLLSTGKSCRQYSKHEIELATDYFSDAKKIGEGGYGNVYRCTLDHTEVAVKVIQQDSTDKIDEFLREVEILSQLHHPNLVLLLGFCPEIGCLVYEYMENGSLEDLLINNKGQPLHWFLRFQIIFDVACGLAFLHGTKPEPIVHRDLXPXNILLDKNYVSKIGDVGFAKLISDL

SEQ ID NO: 62744 - protein, 90 aa, Sorghum bicolor
  unsure (1)..(90): unsure at all Xaa locations
  Clone ID: 18065211.pep
CLSRAARRRPSQATRRRRSRQNGDHRREPPTRRRRAPRRSRXCLSQAARRRPSQATRRRRSRPNGDHRREPPTRRRRSRCPRCRARRSSP

SEQ ID NO: 62745 - protein, 175 aa, Sorghum bicolor
  unsure (1)..(175): unsure at all Xaa locations
  Clone ID: 18065213.pep
TRIDCSCCSKVLSVLEFVAHAGSEVNTPYRNILVDGQDIDLLHCLINAWNMQSDAEKQDFFPVSIEGDDPNDDTCGICGDGGNLICCDGCPSTFHMSCLGLEELPSDYWCCANCSCKFCHEHSNDGAEDTADVDSSLHTCSQCEEQYHEACSPENDSITNLSSQTGXLFCQQSCR

SEQ ID NO: 62746 - protein, 172 aa, Sorghum bicolor
  Clone ID: 18065214.pep
HEEAMAARARGEDELSAEQLETNNRLQEDEVLALQAIYGDDMVILEDKACLRSFQLFVRYPIPNGTKVFLNLHPNGTMVGTDNDGSQDGSELFYACSLKHLPPVVLTCLLPCSYPSTSAPYFTISAKWLDEPKVSHLCAMLDEIWTDLPGQEVVYRWLDWLNSSSWPCISLK

SEQ ID NO: 62747 - protein, 191 aa, Sorghum bicolor
  unsure (1)..(191): unsure at all Xaa locations
  Clone ID: 18065226.pep
TRLLLRGGDVLEKFSDVDAIVFDKTGTLTIGRPVVTKVIASRGMGDANTKDLGANQWTEAEILSFAAGVESNTNHPLGKAIMDAAGSANCIVMKANDGSFMEEPGSGAVATVGEKQVSVGTLDWIRRHGVIHNPFPEAEHFGQSVAYVAVNGALAGLICFEDKLREDSRQVIDTLSXQGINVYMLSGDKES

SEQ ID NO: 62748 - protein, 114 aa, Sorghum bicolor
  Clone ID: 18065227.pep
SAKTIDFYRAWQQGRWRFLGKHEQDVFNLIKHEMAPKLDLAIQFLDTAYISGFCQLSKDLNKICTLHANCCVGLGAKLHDLRGVLDVWRNYTAGTPDERRAGKFQWKLPGICIH

SEQ ID NO: 62749 - protein, 194 aa, Sorghum bicolor
  Clone ID: 18065231.pep
ARGRGGRSSSTTRPAEVPQATVAPQASEAVAAASLPATRPSSRRSRRDVGVKQVVSEVASSVDSDVESIGRWSSRGSDDGGDEAVLLPRPLAAVVARDRSRSNSPAISRNGVDSAAANRAPSTGRSTFAPPVGVNVRPLQAVEIPNGTPRDRRAVYPDPTFAQSTRSRDSHDSSTLTEELEMLKDENVNLLEKL

SEQ ID NO: 62750 - protein, 162 aa, Sorghum bicolor
  Clone ID: 18065250.pep
HEADGKLLATGGHDKKVTLWCTDSLKPKSYLEEHSFLITDVRFSPSMSRLATSSFDKTVRVWDADNTDYSLRTFTGHSASVMSLDFHPNKEDMICSCDSDGEVRSWSINNGSCLTCVKVFKGGATQMRFQPRKGEYLAAASEKVIYILDGETQLACRSPLQG

SEQ ID NO: 62751 - protein, 122 aa, Sorghum bicolor
  Clone ID: 18065254.pep
MARGVTGDAAGSSAAERGTGAAAPPQSATWQRVRRAGQGAAAHALLLCFTTLLALKLDGVLSLSWWVLFIPVWLFHAVAARCLFSLPAPSSPESCQRVPFHSIVATPLLVAFELLLCVYLEG

SEQ ID NO: 62752 - protein, 128 aa, Sorghum bicolor
  Clone ID: 18065257.pep
IIWAALMARAGGRRPRGRRRRSSSLGSLVAADDVAGGRTTSSRPAASFVAIGGRAHSQRTASSRLVASFLIAGGRAHSQQTASSRRSERAEGVLVADGVVPHSWWPGSIAADGVLTAQWVGGRTPPSC

SEQ ID NO: 62753 - protein, 54 aa, Sorghum bicolor
  Clone ID: 18065265.pep
KIIVLQDQLTWNDGNRSGSNMQISLQSILCGYHSVLIVAGDHSRKPYSWHTQQS

SEQ ID NO: 62754 - protein, 41 aa, Sorghum bicolor
  Clone ID: 18065278.pep
INIFTCFVDAHGVTFMFRQVSQQWVLCLHMVSQICAHISNC

SEQ ID NO: 62755 - protein, 161 aa, Sorghum bicolor
  Clone ID: 18065297.pep
ARGLHMDLIKEFEVRETVRDVTFLHNEQLYAVAQKKYPYIYNRHGTEIHCLKEHGKALKLQFLSKQFLLASINSFGQLHYQDVSTGEMVANYRTGLGRTDVMRANPYNAVIGLGHAGGKVTMWKPTSVKPLVTMLCHHGPVTAVAFDRGGHLMATAGVDRK

SEQ ID NO: 62756 - protein, 159 aa, Sorghum bicolor
  unsure (1)..(159): unsure at all Xaa locations
  Clone ID: 18065302.pep
MSTTSSQHGGYPAQRSAANMGSTSSQRGYPARKSEPWTRLTHQERRPQWVAYNPRTMRPPPLGTDTNCMKILSWNVNGLQTIVQSGFSADELVGRENFDVLCLQETHLQERNVDLFKNLVPEYDYTYWSCSVARLGYSXTAVISRVQPISVQYGLGVPE

SEQ ID NO: 62757 - protein, 62 aa, Sorghum bicolor
  Clone ID: 18065308.pep
DEGRIMIAAISFLLGYENAPQEDDSEASSSEDEAYQNPQILLSKQDVYKANHKGTAASKKKK

SEQ ID NO: 62758 - protein, 179 aa, Sorghum bicolor
  unsure (1)..(179): unsure at all Xaa locations
  Clone ID: 18065315.pep
PCLFDLCAAVNVQNGEEVAVKLESVKSRHPQLHYESKLYMLLQGGTGIPHLKWFGVEGEYNVMVIDLLGPSLEDLFNYCSRKFSLKTVLMLADQMISRVEYMHTRGFLHRDIKPDNFLMGLGRKANQVFVIDYGLAKKYRDLQTHKHIPYRENKNLTGTARYASVNTHLGVEXSRRDDL

SEQ ID NO: 62759 - protein, 203 aa, Sorghum bicolor
  Clone ID: 18065328.pep
HEGLEDTSSNANLGKDQTQGSNLRLEQVLPVKQTVASSLNSASPPFYPARSSNQEFPVGQGGNAQLSNNLLRGKAFVPSVGNVGAAMNGMNRPALLPAASSSNGPFPLATNQVNRDYGQPAHPIVQQNPVQSPPRMPAQMFGARFSNSSKISPAQPTSTISGDDAEISSPSGSNKYDSRLTVKGQPDDKGEERAFLYGGAHAL

SEQ ID NO: 62760 - protein, 192 aa, Sorghum bicolor
  unsure (1)..(192): unsure at all Xaa locations
  Clone ID: 18065344.pep
TRVSLNLADYALTAGETIEIILLLSVPGGAPEPAPSLHLTLSMVELRAFQETSDASQRPAATLPLSPSSGDSLPGGKDEVSVIKAGLRKVKILTDLVSTRRPKKTCQDEEGGEDKFYVNSDGAEYPCDTESLDDDLDDIVQEDEFGDSTIRKSFSYGSLQSVNYVGGLVYAHAKIDGEHEDWIYYSXPKSDA

SEQ ID NO: 62761 - protein, 185 aa, Sorghum bicolor
  unsure (1)..(185): unsure at all Xaa locations
  Clone ID: 18065349.pep
ARGLNQSSVNLKSDLEFSDDIQWRPLTMADSGYSNCWATYLQITNECSGLQEYSVEVSIPCSDDIVSRSGSNYNCPVHFTFNIQLISNDAAQGLDMFHKPVAWNCSESFQSHGNRDPIPFDLLNITSALVEQDSXWHFERLSEEIDLFRELPDDNSKFGKLTLARLLLACAAVKSRGRSLIERKG

SEQ ID NO: 62762 - protein, 170 aa, Sorghum bicolor
  unsure (1)..(170): unsure at all Xaa locations
  Clone ID: 18065357.pep
TRLNTPLPEHPKLIRGQLKNGLRYLILPNKVPANRFEAHMEVHVGSIDEEEDEQGIAHMIEHVAFLGSKKREKLLGTGARSNAYTDFHHTVFHIHSPTKTKEYGEDLLPSVLDALNEIAFHPKFSSSRVEKERRAILSELQMMNTIEYRVDCQLLQHLHSEXKLSNRFPI

SEQ ID NO: 62763 - protein, 174 aa, Sorghum bicolor
  Clone ID: 18065358.pep
HEAPWHCQQRLKHYKSFCRRGITISVHSFVYIMSEEMKRLVAYVEDLYEDTNSCNMVKVQWFDKVDEVGVSLPMDFDDREIFFSLGRQDLNVECIDGLAAVLSAQHYEKFKSDTRCSLWQPYFCCRQIDNGEVKPFDVTQLQGYWSQEILRTMFNATSSLKVRFKVPKSGPSSD

SEQ ID NO: 62764 - protein, 205 aa, Sorghum bicolor
  unsure (1)..(205): unsure at all Xaa locations
  Clone ID: 18065370.pep
ARGSQPVAGTQVAARDHLLASGSGTTNVSSAETLATTIVDPIKLRRQVFRRRRKERRVQELLQMDKKVELEMRNAAINSSMNFNNKVRGSYNIWRQEFRFINTDSTLRLMKDQIIMAKLYATIALSQKEPDMYALLMKCIXESQTSIGDALIDSELDSSALERAKAMGHVLSSARDVLYSSGEVSRXLRAMLQSTELNIDAVKNR

SEQ ID NO: 62765 - protein, 203 aa, Sorghum bicolor
  Clone ID: 18065371.pep
TRPPPASSYLLEVVSDLDDYADDDDIDVSWARPPPPALPEANKRDLTETKNEHAPTPVSQKPKLSKAERRAIQESQRAAKAAAKEAGLKPTAMASDASTKISKQPKTAKTSLKKDVNQVNPPVATDKKTGERPPDKDRKKDVPQPRMQFDDAHRVVKAKKRSVVNQSEARNRVELFRHLPQYAHGTQLPDLESKFLQPDLMHP

SEQ ID NO: 62766 - protein, 132 aa, Sorghum bicolor
  Clone ID: 18065373.pep
DVENQISRCIAVTRATWALRHTDQSRFHRHGISQNLDLNSSISHTTVQTTADPNPSCRAPLSGPQLGLESARHQNHRSRNLATRARILGLKRLPQSPSHTEPCTPPTIRSEFPPEETTNQPMSKPSGRDPLV

SEQ ID NO: 62767 - protein, 173 aa, Sorghum bicolor
  Clone ID: 18065391.pep
ARGDYPDAKNQPHVQVALRLKQNGYSGCSAGDTVPYIICSQQDSDNTHSVGIAQRARHPEELKRDPDKWMIDIDYYLSQQIHPVVSRLCASIQGTSPARLAECLGLDSAKFQSRVTESSNQDTSTMLLSVIDDEDERYRGCEPLRLSCPSCSGTFDCPPVSSLITSATSVSDP

SEQ ID NO: 62768 - protein, 157 aa, Sorghum bicolor
  Clone ID: 18065402.pep
HEGPVLQPAHHGAGETLDSDAATPTGALLQSEVSESSLVQLDDGGIGAGVESSCLEDAVSSDGIHGEQEEQEQEQGSNANAATGCDEPDGEAKDGALPLAHTPGAEEGEKQFVVWWRLPFKLLHFCAWKVKPVWSFSIAAAFLGLVVLGRRMYRMKR

SEQ ID NO: 62769 - protein, 97 aa, Sorghum bicolor
  Clone ID: 18065403.pep
TCAGSCGCESKASTLWQLSAASLLASSSSSITLAPTKINTTGTSYEHFRSTSDYMQLPQQQISETIRRRTRCRESRGAATETGGRRGGRRSSSPPSC

SEQ ID NO: 62770 - protein, 191 aa, Sorghum bicolor
  Clone ID: 18065421.pep
TRDISCTEFNMGEGTESIRNGNSSCLTMQEAECGGYPHPDCISVDMVDERSLHDLPHGFSQNNEQYEMEQFPQSICESGSMQMGSPDQYCDDTSLSDFYMDVSSPESISCEQNQSEDICFKSESSTDSSPIPSSRNSTTEDADKYLGQTSKQLLDSKIVPFSNQHTFKNMGYQKPLALHKQYAYRSDNSSI

SEQ ID NO: 62771 - protein, 172 aa, Sorghum bicolor
  Clone ID: 18065426.pep
ARGTVNALQTPMINASMVLCDRHFGGINYPVGGVGGIAISLADGLVEKGSEIRYKANVTNVILENGKAVGVRLSNGKEFFAKTVISNATRWDTFGKLLKEKELPEEEKNFQKNYVKAPSFLSIHMGVKASVLPAGTDCHHFVLEDNWNNLEKSYGSIFLSIPTDLDPSLAPE

SEQ ID NO: 62772 - protein, 197 aa, Sorghum bicolor
  Clone ID: 18065438.pep
ARGWKVESFEEVIRLGSESPVEANMPLPSDVAVIMYTSGSTGLPKGVMMTHRNVLATLSAVMTIVPALGSKDIYLAYLPLAHILELAAEALMAAVGASIGYGSPLTLTDTSNKIKKGTLGDASALKPTLMTAVPAILDRVRDGVRKKVDAKGGIAKQLFDIAYNRRLAAINGSWLGAWGLEKHLWDTLVFGKVRAIL

SEQ ID NO: 62773 - protein, 198 aa, Sorghum bicolor
  Clone ID: 18065441.pep
ARGKHGMDYRLLHAVTNGHPWYGQWGYKFGAGSFALTSDTYQNAVDMLSNINLALYYSHRSPIRTALKNTIALYWALSNRQLVTLRDLFRFIMHLLHQGQKMSKPSTDKHKELTSNELCAWTKEDLHRAEGAMLKVLQVVQTGQWVSWRALRGAASKAVDSQELLDYSLRELGGKQLDNGLSVAVRCNAETSAIEYRL

SEQ ID NO: 62774 - protein, 164 aa, Sorghum bicolor
  Clone ID: 18065462.pep
HEDKIVILKGRGRVDSNTPDGATQQSSTPVKSVPPATSRLDQRPEASGRIIKTILSNKEIRSSNPSQHEQEGHVFNTEKDKRPPRAVNPRTIVKDQLVENSERSHFDEKTNHLHGSAPIGEKVERHARNRDRPDRGVWAPRRYDKSTSGGGSHASSSDFPQIQS

SEQ ID NO: 62775 - protein, 182 aa, Sorghum bicolor
  Clone ID: 18065480.pep
EFEADAALEILSFLKNRYPLEFASRKIGVITPYRSQLSLLRSKFTSSFGPEIVSEMEINTVDGFQGREVDILLLSTVRASNSSGDRHHTGEARSIGFVADVRRMNVALTRARISLWIVGNARTLRINSHWDSLVRDAEERNLFVSIKRPYGSMFEKGQPHSRDTHRYHTSHLKQKDNKKAAL

SEQ ID NO: 62776 - protein, 175 aa, Sorghum bicolor
  Clone ID: 18065490.pep
HEEMGGYKPRLSLHNSLFRALVSKTGGTAKHNLRQAEFVYHNIVTSNLAVHKDIYAGLIWLHSYQDVIDRDRIKALRDEMKRAGFEESTDVLVSWMRAFSKEGDIKETEATWHWLLRSGCELPVQAYICRMELYARSGEPMKSLEIFKEMKNQNIPPNVASYHKIIEIMAKAREI

SEQ ID NO: 62777 - protein, 118 aa, Sorghum bicolor
  Clone ID: 18065496.pep
ASMSPLALLQALFVLLCCSTLALASSSELTLARAACGDDQLVIFDASDGLLNLSVNGVLVQDRVLACHKLGFYFASGCIRCSNLSDALRGAVEQYCGEGSRTLHATLHQDVPRKLLRR

SEQ ID NO: 62778 - protein, 54 aa, Sorghum bicolor
  Clone ID: 18065497.pep
HLDMECNKHGIGPNKTWAVIVIVFSHRQNSLFLVGLVGKQAWVGCENGVVAWTQ

SEQ ID NO: 62779 - protein, 202 aa, Sorghum bicolor
  unsure (1)..(202): unsure at all Xaa locations
  Clone ID: 18065502.pep
TRNTSGSWSVSYANRYVQSETLKLETARQKPCFLPAIEGDSAAIIAAYIFNHLRFGKVNKDISNTNVFEHAGRVFAVAENHLPQEIGIDNLDTSGTWDVGGEWDRPAFTAHPKEAPGSGELVIFGMDAKRPFLVIGVVSAXVDLKLDRSTLCHDIGVTLKHNVIMDIPLTIDISRLVKGGQLIQFEKEVXARIGVMPRYGDA

SEQ ID NO: 62780 - protein, 155 aa, Sorghum bicolor
  Clone ID: 18065506.pep
ARGDDTHLDKKKGKKKSKKAKKDDTEMEEQDDIGEENGRKKKKKKMKKDGMETEELVDVGEENGRKRKKKKKDDSEMDEPDDEGVDMDEENDGAVLESEDGEPNVVELPTESKGKYVPPSLRNASNSESEEITQMRRRVRGLLNRLSESNVESIT

SEQ ID NO: 62781 - protein, 203 aa, Sorghum bicolor
  Clone ID: 18065510.pep
TRLKLQNLDLSENGLSGTIPISLSNLSSLNNINLSDNSDLHGEIPENLLQVAQYNYTGNHLNCSPQSTPCEKRTAKTGPKIKSNVWILVVVSSLLGVALCIIFCFGPIMFRSLSKGKQRVRDRSNVVVHRDIFRKKIVHRDEELVWGTEGNNLDFTFYNYSQVLDATNDFSVENKLGQGGFGPVYKGRLPDGLEIAVKRLASH

SEQ ID NO: 62782 - protein, 65 aa, Sorghum bicolor
  Clone ID: 18065513.pep
IIYPPIDSNSQYSTRLKQTTMSKSFQHSQTRRPEVSNKIDNRNMNLSFDGIFGSTNFKVVKEKQT

SEQ ID NO: 62783 - protein, 147 aa, Sorghum bicolor
  Clone ID: 18065514.pep
ARGIDISGISDKPLVKRLKKLFRSLRLKESASGAYLLPPKNVPTLDIVGSLLLAGSKLSDNKSEKSVSPYREELPQANFDVQNKDKDDSISEEPKIIGVEEEPPKRRVIGPAMPSRELLAAAAEMTEALRCRDAELEADDDLLIGPP

SEQ ID NO: 62784 - protein, 135 aa, Sorghum bicolor
  Clone ID: 18065518.pep
RMVGAGEDAAAVCPWDPVRQGPFSLYISHSFSLFFPLGVATQRRMRCRLWRSTTQRRQGRHHRRVPKIQRGEPLLPAQGHGVAALLEPLLPRTDPWRWRHHARPSSSLRSPMAALLEPLLPRTDPWPQPWRRKCF

SEQ ID NO: 62785 - protein, 192 aa, Sorghum bicolor
  unsure (1)..(192): unsure at all Xaa locations
  Clone ID: 18065521.pep
HEAISLYISMELVRLGQAYFMIRDTRLYDESSNSRFQCRALNINEDLGQIKCIFSDKTGTLTQNKMEFRCASVDGIDYSDIARQRPPEGERIWAPKISVNTDRELVKLIRDGADTEQGTQTREFFLALATCNTIVPMIADGPDPKKKVIDYQGESPDEQALVSAAAXYGFVLVERTSGHIVIDVLGEKLRYD

SEQ ID NO: 62786 - protein, 177 aa, Sorghum bicolor
  Clone ID: 18065536.pep
TRTYLLLLGILAATVTYQAGLNPPGGFWTDSVDGHIAGDPILETMQPRRYKVFFYCNATAFVASLVIITLLQSQLITVSAMKRHILQTAMILDLFGLMGAYAAGSSRKFSTSLYVFVLVLLVFIYVVIHVLLSLALMTRPRRDDAMENEDEDLEKRRKFLMLLAILAASITYQAGIS

SEQ ID NO: 62787 - protein, 140 aa, Sorghum bicolor
  Clone ID: 18065537.pep
GSDSFTFFKLNTSMLPIEVIKMDIGITIQATISIASSVNTSLWESLRKHARRNPSRLKNKMQFINRGSCNANADTAPSSAPSWRTNQMLNTNGITLERNCAAKLYLKTPITAAPAAAAGGAAAAAAPAPARSAASSIAAY

SEQ ID NO: 62788 - protein, 181 aa, Sorghum bicolor
  Clone ID: 18065561.pep
TRLVPVHHKDSLEDITDTAEIIEERPTRQPSSGHHLDTVDNSDDHKTHDEACDSAVASLSVDAERKLSICNSMNVHENVSSKDSELCSADYSQKFNRSDETCDIHKEVSSTVNDPDERKCTDDPTGCTNMTQSMQVSESCDLPHGKFVSSPEEHDFNGRLESNRLSPSRDEPDLNSIDMEV

SEQ ID NO: 62789 - protein, 132 aa, Sorghum bicolor
  Clone ID: 18065567.pep
ARGRTLSNMRTPSYVGEITLTDFSLGELPPYVHAMRVLPLDLNELWAFEVDFEYSGGILLHIETRLEVQEPELQKDIMKSNFGADANGEVDSDLLESIEQYGNQFKGSHKSASSMGGNDEAGLFWFLMSFLV

SEQ ID NO: 62790 - protein, 87 aa, Sorghum bicolor
  Clone ID: 18065573.pep
TRLPPRPARPPVPEPPLLLPLRSHTPVAPLSLPPPHPPSHPRKEYPFRGVPCFFPTPPCISASLYRLISRSLCALSPSWILVASAGS

SEQ ID NO: 62791 - protein, 88 aa, Sorghum bicolor
  Clone ID: 18065579.pep
NRLSLNYLYVITLAPLNRYSDDLECLVLLEKVALAPVANLSIDTMHSSISIHAWSLTFLSAGANSFHSPVAASWHKWIWMYMLLEPRA

SEQ ID NO: 62792 - protein, 188 aa, Sorghum bicolor
  Clone ID: 18065585.pep
HEGDGEGTNVLSIGAAGCSVTHIRNPKLKENYTSVDVRSGTIVAPGGRMDWINAICLLFSSGSDRTEKSHDSNTVNSYQSGEPYSSSLFLELADVAVSYEPHFKNSTLSAGATDRKFFSCLLAASSFKLHNKSASASAATDFDIQLRDLGVLISQSSGSTNATCSYGVDYLRQVGYTKVAQNTFIEAS

SEQ ID NO: 62793 - protein, 66 aa, Sorghum bicolor
  Clone ID: 18065587.pep
IFSGEGRSNSSRAGAVSPAVLIDVDAAPTPAAIGKIMLCGTDNIVEMFLDEAVEKKKAKIVSYPCN

SEQ ID NO: 62794 - protein, 201 aa, Sorghum bicolor
  unsure (1)..(201): unsure at all Xaa locations
  Clone ID: 18065594.pep
HEAHSSKLLAELSVSLSQGQYTLKDGIIRYNQRIWVGANPSLQQKIMFSLHSSPVGGHSGYDVTYKRIKHLFAWSQLKQSVKDFVAQCTVCQQAKSDRTAYPGLLAPLPVPEGAWHTVTMDFIEGLPKSSGHNCILVIVDKFSKYAHFISLAHPFTAFQVALLYMNNIFKLHGMPQVIISDRDXIFTSHLWQELFRLLGTD

SEQ ID NO: 62795 - protein, 131 aa, Sorghum bicolor
  Clone ID: 18065598.pep
GITIEKKYDATFLLISFFFLKSFQHDMQVRDKALLLLDSWQEAFGGPGGKYPQYYWSYIELKRAGVMFPRRPVDAPPVFTPPATHQAYGSPRYTSGSLNERITSDAGTLSFEGLNNIRNATELLCDMVNAD

SEQ ID NO: 62796 - protein, 139 aa, Sorghum bicolor
  unsure (1)..(139): unsure at all Xaa locations
  Clone ID: 18065605.pep
MDKGLFTNDGSFMERFKQMQQEAQEKEKAAAAAASSAPKHANPKQGFAVAANKRPFELKKAAPVASSGKLAFSLKKAKVAVAPVFSADDEDEDAADVEREEPAKRQKSVQADAPVAAAPXXAVAPPPSXDITVRQVADK

SEQ ID NO: 62797 - protein, 163 aa, Sorghum bicolor
  Clone ID: 18065608.pep
TRPEPRAAAKNRPPADAPIREEDEDEEEDDGHIKTDSDDDDSDEDDDHHEHDDVNVDGMVHGQQPKRILMSIVGSSPVTPPLPPRLNQTPPTPATATPPPPVLESQMATWDYFFGPTPTPPPTLEQPADNTLWMERRDNEPVAEVKAPVAKPVVSEPAATEER

SEQ ID NO: 62798 - protein, 194 aa, Sorghum bicolor
  Clone ID: 18065618.pep
TRRRSAADCSESDSCTSDTDMVELEKSNILVMGPTGSGKTLLAKTLARFVNVPFVIADATTLTQAGYVGEDVESILYKLLAQPLPLRRPPVLFILSWTWDGNGTWHMKYVKILKIYIKYKHWMSPSQAADFDVAAAQQGIVYIDEVDKITKKAESINLSRDVSGEGVQQALLKMLEGTVVSVPEKGARRHPRGD

SEQ ID NO: 62799 - protein, 141 aa, Sorghum bicolor
  Clone ID: 18065619.pep
MGSEPKRTESSHTTEEETGTHLFKIIGYTLTKGRGVGKSIRSGIFTVGGYDWAIRFYPDGSTEATKDSVVVSLVLMSENAEVRASYDLSLVNQTTGLPENVFRESTFRVFNSCKGNWFTPRIIISKRNKLEFKSADYIVDD

SEQ ID NO: 62800 - protein, 193 aa, Sorghum bicolor
  Clone ID: 18065623.pep
ARGDEDEFGSAKGEEKSKKSHDKRLDSVAVEKKGVNGNHIAAPLDSASTEKQADLRQTNGIGNHQHHTEDSESNGLEKLEQSNMGNKRGGHTAGKKPRHGESKQQKHSAVKPVNHCEDNIGVKEEAMKDVKLVFGEDIRCARMPVNCSLSQLREIVQNKFPSLKAFLIKYKDQEEDLVTITSSEELSWASNLA

SEQ ID NO: 62801 - protein, 159 aa, Sorghum bicolor
  unsure (1)..(159): unsure at all Xaa locations
  Clone ID: 18065627.pep
MGSVGSSIGYSALMGSVGSSIGGGHMDPMHIVGMRAHAAAHRHSYSHGIGPCDDGHNGNDEEPSQARHVVVSQILELGIVSHSVIIGLSLGVSQNPCTIKPLVAALSFHQFFEGFALGGCISEVNIXAQFKGFSTLLMAFFFAITTPTGITVGAGIASF

SEQ ID NO: 62802 - protein, 204 aa, Sorghum bicolor
  Clone ID: 18065628.pep
HEAEKEKLYAYLKTVTCRFSTTMDIWTSCHNKSYMCVTLHWIDDNWHIQKRIAAFFQVEGRHTGHKLAEIFTEVMVKWFVEKKLFALTLDNASNNLVAVTDLIDDLTQNGNASLVCDGMFFHIRCACHILNLVARDGLAVINTALGKMKSLALTVKGSPLQWEELMKCARECGLDTSKGIQLDVSTRWNSTYLMLRDVLHYKPA

SEQ ID NO: 62803 - protein, 88 aa, Sorghum bicolor
  Clone ID: 18065636.pep
TRVLRQLHKLPWAECQQYLLKCFLKVHKGKNSQVHLIALLTASLSRYHDDFAVAVVNEVLEEIRVGLELNDYGMQQRRLAHMRILGEL

SEQ ID NO: 62804 - protein, 176 aa, Sorghum bicolor
  unsure (1)..(176): unsure at all Xaa locations
  Clone ID: 18065644.pep
TRVYTKGGIVAQVKEPKVLRFKALRDAMRDPGDFLLSDFSKFERSPVLHLAFQALDKFKKEHGRYPTAGCEQDAQTFLKFAADINEASVGPKLENIDEKLLCHFASGSRAVLNPMAAMFGGIVGQEVVKACSGKFHPLYQFFYFDSVESLPTYQLDPQDLKPSXSRYDAQVSVFGS

SEQ ID NO: 62805 - protein, 140 aa, Sorghum bicolor
  Clone ID: 18065659.pep
HEARIELCLENHSRSAAADNTENSTLAKSNIHHDRAHSSVEFALTFVLDHALIPHMNVAGGAAWLPYCVSVKLRYSFGDNNHIAFLAMNGSHGGRACWLQIEEWETCKQKVSRAVETVNGSGVAGEVGQGRLQMVAEMIH

SEQ ID NO: 62806 - protein, 185 aa, Sorghum bicolor
  Clone ID: 18065673.pep
TRVIPKAKMTTSIAIEDVRREVKILKALAGNKNLVQFYDAYEDNDNVYIVMELCEGGELLDRILSRGGKYSEDDAKAVLVQILNVVAFCHIQGVVHRDLKPENFLFTSKEENSNLKAIDFGLSDFVKPDERLNDIVGSAYYVAPEVLHRCYSTEADVWSIGVIAYILLCGSRPFWARTESGIFRS

SEQ ID NO: 62807 - protein, 155 aa, Sorghum bicolor
  Clone ID: 18065690.pep
HEAEVLFLGIQNIHTMRDSLSRLRDYVDAHGSISSNGSPSAVSVVGDRRNRGSTWGGGNLNSMTSFSSTLGEWLNHIQNILVGASWIAAQISEEAASVLVHCSDGWDRTTQLVALACLLLDPYYRTFSGFQALVEKDWLPFGHPFAERMGVPTVA

SEQ ID NO: 62808 - protein, 163 aa, Sorghum bicolor
  Clone ID: 18065695.pep
TREVGTKVGAYMRTFSGDCSPSDLETALQLVYQLFTTNVEPREEEVKIVMQMAEEAIYAQERDPYTAFANRVREINYGNSYFFKPIRISDLKKVDPIRACEYFNNCFKDPSAFTVVIVGKIDPAISLPLVLQYLGGIPRVQDATQPLSRDDLRGLPFKFPATI

SEQ ID NO: 62809 - protein, 116 aa, Sorghum bicolor
  Clone ID: 18065701.pep
TRLGTRLARLTGRQPRLFATSHRTAAISVSARALPTVSDLLLPRHQRRHAWEPEDPLQLASGESEPGRRGIVRLSTAVFSRWKAVSTTYLKRLLSGEMEKTEQEKQARFIGSKALS

SEQ ID NO: 62810 - protein, 92 aa, Sorghum bicolor
  Clone ID: 18065722.pep
ARGSGAKQKKVPVSTAKQTASLDDPFVVLETTSSSAHPFADPLDEFGKAAKYQGKSRESTSVESSLDSSTFNQAPKSEPFFTSEVDNGSKGR

SEQ ID NO: 62811 - protein, 106 aa, Sorghum bicolor
  Clone ID: 18065725.pep
TRVDLNALKSAACRRYGLARAPKLVEMIAAVPEADRAALLPRLRAKPVRTASGIAVVAVMSKPHRCPHIATTGNICVYCPGGPDSDFEYSTQSYTGYEPTSMRAIR

SEQ ID NO: 62812 - protein, 203 aa, Sorghum bicolor
  Clone ID: 18065782.pep
HEGELEQYASTLRESGGPLSPSRILSNLRNIGCRLGGGTQEDAHEFLRHLVMSMQAACLDGLGGEKHVEPSLQETTLIQQMFGGRLKSKVKCLRCYHESERYENIMDLTLEIHGWVESLQDALTQFTAPEDLDGDNMYKCGRCSAYVKARKQLSVHEVPNILTLVLKRFQSGKYGKINKCVTFPDMLDMVPFVTGSGDNPPLY

SEQ ID NO: 62813 - protein, 134 aa, Sorghum bicolor
  Clone ID: 18065783.pep
NNNITVSEAAFLSRITQGQSMHCGNREATHGKGDRNYESSSRGKWGLASSSSSCFGTAAAAAFPSSLTRCCSDVGAGVAAAAVAAAAAASGGGTGAAPAVSGHGEEAIGCAVIQRPVCREAGAEKFLLVNRCLV

SEQ ID NO: 62814 - protein, 131 aa, Sorghum bicolor
  Clone ID: 18065785.pep
ARGRLLAVATLDGRIKIFGGDNIEGLLISPKSVPYKFLQFITNQGFLVAISNENEIQVWNLEFRQLFYSSQWDINITAFAVIEGTFMMYLGDENGLLSVLKYDVHDGKLQIMPYNVHIHSLIRITSTPFLP

SEQ ID NO: 62815 - protein, 117 aa, Sorghum bicolor
  Clone ID: 18065815.pep
ASLTKRTFSKQKRPQQIHRFLGPQSRLSIPPCAAGKEQKGCQKDCSNDLVFHTAVKERNGLRHFCNFTITVSLSAWTKNIKEQIIVVSQPMITCFLRMKAMLQHAWNEVCHIAMPCL

SEQ ID NO: 62816 - protein, 61 aa, Sorghum bicolor
  Clone ID: 18065830.pep
TVLKGRVYNIAPYMKFHPGGVDMLMKAAGKDCTALFNKYHAWVNAEFLLEKCLVGFLDPNE

SEQ ID NO: 62817 - protein, 133 aa, Sorghum bicolor
  Clone ID: 18065839.pep
VQIAEVVSCSVCLDDLELGSHAKQMPCEHKFHSPCILPWLELHSSCPVCRFELPSEETKDLNEPSNVDRTESPQEEVRADGPENASESSNRAWALVPWFSGLFSTPEPQTARGAFTDQQTPSAFGTNPNAGES

SEQ ID NO: 62818 - protein, 71 aa, Sorghum bicolor
  Clone ID: 18065845.pep
ERRFLPPAGYNKAGYNTDLGSDFCSRSPAEYSAERQQVRFDPFTGEPYKFDPFTGEPIRPDPNPRRSGSLY

SEQ ID NO: 62819 - protein, 65 aa, Sorghum bicolor
  Clone ID: 18065850.pep
SSINLLLGRNLDVFHRRCLRRAPLTLVIKRGHGAGCKQLHGGHEDAVQKPQEQPFSHVSYGASLG

SEQ ID NO: 62820 - protein, 75 aa, Sorghum bicolor
  Clone ID: 18065851.pep
WSTSYEVVLTLDKEKHKVDGPIYYYVFNSLLFSLLVLHIYWWVLMYRMLVKQIQSRGHVGDDIRSDSEGEEEHED

SEQ ID NO: 62821 - protein, 208 aa, Sorghum bicolor
  Clone ID: 18065859.pep
CQEQSVGDISCDEDTHLGYSTSIANLSITSTSCKSPRSKQFAEHKHECGGAHWAAVLPTDVVLAGRIMARSIEKMMLSGKRFAISGPNLDLVHHYDQHSPANKLESQIYAIVLLLCLQNHYRSDLLWTEDSLSQLVLLIFQIKVNSIAIVRVRSVDGSPELTVNRGVSGAEGANMCSVEQVRVAQAVYVSGSLFNHSCQPNVPCIFLS

SEQ ID NO: 62822 - protein, 125 aa, Sorghum bicolor
  Clone ID: 18065864.pep
IPLVSVGDDGRLFTVGGNDGKNKFELVNREKRKLTLCDIPLSLTCALHKDSILADPTSEEESIIETYVTVVVDSSDRLVSLQKVGGAVTSMATIKECISLAKERRQSLREILIDSVKAMEVDQTE

SEQ ID NO: 62823 - protein, 112 aa, Sorghum bicolor
  Clone ID: 18065869.pep
KDAGCVILRDMKVRFLILCLSVTLVRFFCHASILCHTLNIILPATENANIRPDDDDEGCCLFVSRNPIGISKCQGHCSLQFSEQGAVMHWRCHCTITTAGNDSDGFLMGIVL

SEQ ID NO: 62824 - protein, 93 aa, Sorghum bicolor
  unsure (1)..(93): unsure at all Xaa locations
  Clone ID: 18065875.pep
IDAKKQERAKRMEEKEVYVQLYEAVEAFFHMANSMLDXTGPRDQALKGSRAAVCKFPTYCKGIPAEFGCLVAVPTASECSNSLSCIPRMYSLL

SEQ ID NO: 62825 - protein, 55 aa, Sorghum bicolor
  Clone ID: 18065902.pep
PVSAPGRPALRDLGGFRAGKSVFGSKVQIVQGGILGGICFPVFVRCLNPEKKIGG

SEQ ID NO: 62826 - protein, 79 aa, Sorghum bicolor
  Clone ID: 18065913.pep
HPNMKLQPKVKKAKAASASKAVKGPCIDQNALHLMRGMTSTRRKDLMECIKQQNAKHESRRCPASDPLDKKKRKVVLQY

SEQ ID NO: 62827 - protein, 60 aa, Sorghum bicolor
  Clone ID: 18065919.pep
CTEENLRFDLDDERVIVLKYQNAKLATSRVLKRHRIPSAISSDLVEDEPTNGEVETSCTS

SEQ ID NO: 62828 - protein, 58 aa, Sorghum bicolor
  Clone ID: 18065923.pep
SDRMFAYLDSLGMMKSFCSNVVVLRISCRMTVKTNGYELDQFCTLLFSITVVDMLIHE

SEQ ID NO: 62829 - protein, 44 aa, Sorghum bicolor
  Clone ID: 18065932.pep
TPFIFGSISFKTCLISGCKILGCYIGCYIEGLYCPLIKKIPESV

SEQ ID NO: 62830 - protein, 41 aa, Sorghum bicolor
  Clone ID: 18065964.pep
GSHEIPDRFNCSLKQIYIPADHKPSTEPIAQDTLLAFLMMI

SEQ ID NO: 62831 - protein, 93 aa, Sorghum bicolor
  Clone ID: 18065990.pep
ESRGTEASTSMSTENTSVSINVPKLAEGIEFGRQPMVTSSTLVELTTRLDFFKERRSQLMEQLHSLDLGRGSAPQGFPYKPPSPWNHPRRIAP

SEQ ID NO: 62832 - protein, 104 aa, Sorghum bicolor
  Clone ID: 18066026.pep
FIHHSRSAHHHHPIDNSYASFCYHWKITFHSHRQPPVSVIGIDQSPLLDLSTFCYFIIGIITHLQLLCEPVTTLSPADLYFIDSHIRVQRYVSKNGVNTCPAIL

SEQ ID NO: 62833 - protein, 124 aa, Sorghum bicolor
  Clone ID: 18066030.pep
SYKLIINLLSWISKTTTTTTMPHILESCSVSQVMIHRMLKSCSVGSSVPSNDPPNAEIMPCSSSSTTSQMLNLQEVRQLLFFPGAPFAVQVVPLLELVHHSTLGGEARCNLVLCLPEVFHRQWP

SEQ ID NO: 62834 - protein, 64 aa, Sorghum bicolor
  Clone ID: 18066047.pep
INEVQVGVYFPLDWDRIRAARDHETQYKILEEEGQEARRKKGELKKKIQEQLAQNTNQPIVTVG

SEQ ID NO: 62835 - protein, 69 aa, Sorghum bicolor
  Clone ID: 18066072.pep
FGPTDFENQAFFSFLHKKVCMKGRAAQLKDSYIKTRFFGGANELYARNGKLPPRLPKFQLFRTNDQWSE

SEQ ID NO: 62836 - protein, 88 aa, Sorghum bicolor
  Clone ID: 18066076.pep
TRRSSRSLSLYHLSSGRTWDVRYGGVAVLVIQRAPKLSMAPSHPSSSGNRDISCTCVRKRRTPKPLHGSVQHAPTKLYAPKQTTSSIS

SEQ ID NO: 62837 - protein, 94 aa, Sorghum bicolor
  Clone ID: 18066089.pep
QNSTFSKAVTRRMSEIYIARARPTKDYSTFHDFTYSSLRTLFFPLGLLERFRYPADFCELQASLCLIRYRSPHVDKFNLTMAYTVPVQLSICST

SEQ ID NO: 62838 - protein, 51 aa, Sorghum bicolor
  Clone ID: 18066099.pep
MGKVSNQQTDELTNMHRKGTILSINMVELSKELQASPTEHIREVTKNRLSC

SEQ ID NO: 62839 - protein, 102 aa, Sorghum bicolor
  Clone ID: 18066116.pep
QGECSLAQSTGLAFTCHSFTQPKYQSASNLGPQSLAEPHLEKMESDQASHFLEAQYHRLGLAWEPLAVPQLVKLESDQNPFLEARYRRLGLSWDCEFLLEPL

SEQ ID NO: 62840 - protein, 60 aa, Sorghum bicolor
  Clone ID: 18066145.pep
SETKTLKNVNRKSAQLKIVDRRRMIKVLLPLQAGQRMLFWFLGTLYMYSLMIASVFGSAF

SEQ ID NO: 62841 - protein, 125 aa, Sorghum bicolor
  Clone ID: 18066151.pep
ASWYCVAWYPIYRIPDGKFQAAFLTYHSIGHWIHQSSSADGAVVLPVIGLQSYNAKAEWWFEMSKSDSEGAESAEHQSSEASQILKERLHTLNESAAVMSRASVLKNGQMSRNRHPDYEFFLSRS

SEQ ID NO: 62842 - protein, 109 aa, Sorghum bicolor
  unsure (1)..(109): unsure at all Xaa locations
  Clone ID: 18066164.pep
KLLAVEFLHEEDAVFXVLLLCMVIARTMTEIRREDVAGLLVRRRISEARAGQRDWGSVMLPGSLSPDPHLQPWYRNAAQVLSSVETGPMLAKYSPADGKDMLYRQALIP

SEQ ID NO: 62843 - protein, 122 aa, Sorghum bicolor
  Clone ID: 18066169.pep
CETMKWWGTSSDTDCVPAKDGSHEAHDLTTHEPSKGMTDDDELDWGADEAEAEAEADGAVTAEASAQLCSLRRKAVDDGRKLLNGGNRRGQEFSRLNKRQKLVLAQVFGASLPDVVFLVSSE

SEQ ID NO: 62844 - protein, 82 aa, Sorghum bicolor
  Clone ID: 18066171.pep
EVSYQTIWVAVLNARCYRERDIDQKEGFVTMVLNKIGKVAYILSEPSCSKIDPVIHVSQLNQHRTGPAFLGTRSMCLFIIKS

SEQ ID NO: 62845 - protein, 64 aa, Sorghum bicolor
  Clone ID: 18066175.pep
METQHLPTRKNIIHALQIRSTLVIEDALHDETLQNRILTGNFAFCSGDLLGGGYHVGALSREIG

SEQ ID NO: 62846 - protein, 145 aa, Sorghum bicolor
  Clone ID: 18066191.pep
CENKHSYELLLLPGTNICGGLHIRKLDDNTYQPTTWQIKFNLDSVSPSSTYKFRVALASSALAELQVFFNDQDKARPHFATGLIGRENAIARHGIHGLYWLFNIDVASAWLVQGVNTIYLKQPRSQSPFQGLMYDYLRLEGPCGC

SEQ ID NO: 62847 - protein, 228 aa, Sorghum bicolor
  Clone ID: 18066202.pep
MLQCSSCLLSAHDSCFGSSLTFEDPRQLHCPVCIYAKATEEYKKTKKTYIEARKSLAAFLGAEQLLKQHEQQTRPLPRAVYSEGQLNGHSNSSEKQTSVSETTIDDLAHQGEESNRQRKKQKIDVTSDVCNEVVIEKASSVGNSDVAPMNASVLQNKSNQLQDAEQDHAENTEAHEGSSSQNRCSPAANPEIETDKEDGPTHSHHQSKDTDEIEFTSSSDSGKPLSPP

SEQ ID NO: 62848 - protein, 97 aa, Sorghum bicolor
  Clone ID: 18066218.pep
QGIKGPKAQLMIPYATHLLQFTEAVFKDRSRDDSVTKAAVAVIGDLADTLGQSSKDLFKTHLFHVEFLRECQAQEFDDEVRETAQWAQGMINQAVVS

SEQ ID NO: 62849 - protein, 104 aa, Sorghum bicolor
  Clone ID: 18066232.pep
LAFGFDWPVSDINPLQAIRTAMFRKPPGWEVPWIPAERLTLDESLKAHTMFAAYACFLDHAVGTLFEGKYADFVVLPFTSWDEFSNDVPGQVLATYVSGRQAYP

SEQ ID NO: 62850 - protein, 119 aa, Sorghum bicolor
  Clone ID: 18066240.pep
ESRMFMSQNTRRVIGQHTGKYQKFTPSCPCHVQKQCLNANNYCLKTNPSITQPKTSITKELLIANISSLFLNLRYVDFNPLAADFTHIALPCRIASGFHGLANHLPWYKHIRRAGSQKS

SEQ ID NO: 62851 - protein, 74 aa, Sorghum bicolor
  Clone ID: 18066243.pep
LHLSRILTKSDGSTSIPSKLAKCAVFSYLPFLNHKLGAQMMCLPTCDCLDLGSSVLLSIRICTRVHLVPQIHYH

SEQ ID NO: 62852 - protein, 46 aa, Sorghum bicolor
  Clone ID: 18066298.pep
LLGASRKNESSGWLVDLVQYLNPQKKIMGKGICLLMLSGGCDCYLP

SEQ ID NO: 62853 - protein, 103 aa, Sorghum bicolor
  Clone ID: 18066300.pep
EYKTAGCCAAAPHTTCEPQDEAMPIPSAETMPAMLACRPRVCHMQLTIKRCTPHTTVTPKDPSQNLSIHQGKERHSRAGWYSFSISTQPPTTPYYRLPQSQCN

SEQ ID NO: 62854 - protein, 71 aa, Sorghum bicolor
  Clone ID: 18066340.pep
KKDKLFFIQTTLPEHMLASYRGRAKTRNNMCTCQINTFRLSPLQEVKEKKNHWNEAKTKNKCQLQAHRAWR

SEQ ID NO: 62855 - protein, 57 aa, Sorghum bicolor
  Clone ID: 18066372.pep
NGINIVHIIQGVGWVADFTLAAKSNKTSLSYSTLSRYWCQIEVLLQHSEHFCKRGHL

SEQ ID NO: 62856 - protein, 75 aa, Sorghum bicolor
  Clone ID: 18066381.pep
MATANQQLQKAAKLLDTGAVRATRFLWRHPVARVTLLFYLVFVHLFLMHLLNRLQDFASREGNSAMGGLASANLP

SEQ ID NO: 62857 - protein, 112 aa, Sorghum bicolor
  Clone ID: 18066386.pep
MASMDEEVHGNRADDGSSRGHERSSSIRALDMKSRTRCGARCCLCFDPLPIQDISVIMFYCCHAYHLSCLEGGLDSMRSTSNQDSDSGTDDEDGSPSGQSRMRCVLCTTAAA

SEQ ID NO: 62858 - protein, 94 aa, Sorghum bicolor
  Clone ID: 18066400.pep
IREKIKNFNLSFEDVYRVQTAWSIPDDQLRDDVRISISLKVIQAYRTFEGRYSGFLDGTRHRDRYVKYRPEDLETLLLDLFEGNQKTLQHSCRV

SEQ ID NO: 62859 - protein, 81 aa, Sorghum bicolor
  Clone ID: 18066405.pep
DGVVAQLQAARRALGEKDVAVPGMTRGDTPRLRVLDQCIRQQKALTQAGMVEAHPWRPQRGLPERAVTILRAWLFEHFLHP

SEQ ID NO: 62860 - protein, 138 aa, Sorghum bicolor
  Clone ID: 18066447.pep
TAAIHVSSVCWSEPLREGRCTRRQVVIKLLSACTPQQVMKERCSSGRKSATCHGCMADGTHGLAVNSLVSITPVNMIPDGSICDIISSCIQIIVGGSSVAANLEEPSLYASASVGPLTAGEGHGPGEDTSGCLLQSAA

SEQ ID NO: 62861 - protein, 117 aa, Sorghum bicolor
  Clone ID: 18066455.pep
HRDKDSKWFISRKEWPFDMYPPWAHGPGYIISRDIAKFVVRGHQELTLQLFKLEDVAMGIWIQQYKNSGQQVNIVTDDRFYNEGCDADYVLAHYQTPRLMMCLWEKLKTEYQAVCCE

SEQ ID NO: 62862 - protein, 57 aa, Sorghum bicolor
  Clone ID: 18066471.pep
HYPWPPSYQKVDRLLLAPQYLPPPAYIHMGLPDTHKASLLSTTNWVMKPTQTPPSHK

SEQ ID NO: 62863 - protein, 109 aa, Sorghum bicolor
  unsure (1)..(109): unsure at all Xaa locations
  Clone ID: 18066474.pep
HTRQRVQVVNPRWMCAGRTLHRQQRARRARDPVPLHQPKRVQDDWHSRSAGEGSPSRERRACSSATATASGPSPTGATSARRTTTASMTLVHCRSHNTSCLLHIYXYRH

SEQ ID NO: 62864 - protein, 59 aa, Sorghum bicolor
  Clone ID: 18066518.pep
KNITIQPQTSVTAKQGRDPKLLFPPPPQKLWAKIPQKRGFPINPLGGFCCYLPQKGFRS

SEQ ID NO: 62865 - protein, 53 aa, Sorghum bicolor
  Clone ID: 18066555.pep
IEPHELDFSVLKEESYFVGLHFILPPKICRQSYWNDNKIFPFLVGKYQMGQVL

SEQ ID NO: 62866 - protein, 94 aa, Sorghum bicolor
  Clone ID: 18066573.pep
IGHNSFLAFNFELLAVSQRMHPLSIVQTNDYNNYKKPIPYVCDKLCCISMTFCICAAFQIPLGLVQGRVTHIIWPPSRTGRVERKIPEGRISPG

SEQ ID NO: 62867 - protein, 117 aa, Sorghum bicolor
  Clone ID: 18066593.pep
TILELVDCADEQRWQWHARGVCTQPQLWTWTRCSCGLDNKEMRLSMKKIAYRITRRGLPGNRATGPISVSVDSQCSRSGNSPEDIVSLFIGSETIGNSPEDIVSFFIDSPEDHRYKS

SEQ ID NO: 62868 - protein, 47 aa, Sorghum bicolor
  Clone ID: 18066599.pep
QSFITMYSVLSPPGQLCFSIFAALWLLLPAGPLYCKPPSKKINGIFR

SEQ ID NO: 62869 - protein, 61 aa, Sorghum bicolor
  Clone ID: 18066605.pep
FGISVFFFIFYSSACYKYKEDTVKLFMVVCSCCLCSLVASRCICGFRGVTYTVWTHATLQK

SEQ ID NO: 62870 - protein, 85 aa, Sorghum bicolor
  Clone ID: 18066607.pep
CSMTMTLFSNAANGRVSSDKHFRMDALIQNSKCSLTDIHLVNYGILEITLVHVICRQYPTSVVITLWMKQGFLSAWKLYISFLIC

SEQ ID NO: 62871 - protein, 111 aa, Sorghum bicolor
  Clone ID: 18066630.pep
FGVHPKNLMDKEHPIYITSLVPLSSSPILRLMPPQREIDASKGRLPKVLLGDLIVGSAVLPKKEFQVVVWESRIPPYKRFVHLATYCDDEPVVSSQHHTASPSMKRRRLDK

SEQ ID NO: 62872 - protein, 126 aa, Sorghum bicolor
  Clone ID: 18066637.pep
STPRMTPPGSPPRRYASVSPPRRHSISVTSMNMLNDRSSGFSGQHTSPFDAPSQTGRTRVDGKEFFRNVRNRLSYEQFGAFLTNVKELNAHRQTREDTLRKADEIFGPENKDLYTIFESLITRNIR

SEQ ID NO: 62873 - protein, 57 aa, Sorghum bicolor
  Clone ID: 18066641.pep
MCLIAQNLLQLVPSQSMTRPPMCLLNHNIFQLAPSKAMMRWHRLFNKPRRHMKNYSL

SEQ ID NO: 62874 - protein, 65 aa, Sorghum bicolor
  Clone ID: 18066648.pep
VLSNMRVLMTEDSNSAESGSFLLDDNSSIPFSVDDITNSMQEKDFTDIKPADELLENPAFQFLQD

SEQ ID NO: 62875 - protein, 105 aa, Sorghum bicolor
  Clone ID: 18066652.pep
RSSQGGKKNESRQTSNPPFPKKKMVTLFYLSPEPSYASSQLGGLLPQKMTKGSCACLHAWFRVIKVLPHTGAKWPVWSLHCSKLYAHKYSLPLPSDPASITLTCD

SEQ ID NO: 62876 - protein, 51 aa, Sorghum bicolor
  Clone ID: 18066666.pep
WIAHVIELPHLWVGSCGVLVRTRFVLHLLATGPPSVGRHNKDVACRQARNS

SEQ ID NO: 62877 - protein, 48 aa, Sorghum bicolor
  Clone ID: 18066686.pep
IVFFSDPFMYGFFPNIGQCIGWRGSWISQLCTLGSLFHSYKQQHVMLD

SEQ ID NO: 62878 - protein, 56 aa, Sorghum bicolor
  Clone ID: 18066687.pep
NYVEPCDPKNNCTCHCKFGTAQTLMYILGKSKYQREKEKEKEKEKEREALLMYSGT

SEQ ID NO: 62879 - protein, 65 aa, Sorghum bicolor
  Clone ID: 18066699.pep
TVCPHYKLNYNIFTTHTTMTCWLTWPLPHGISQQSIITLTLYAVISTATDNSKHQSTNQSFITLN

SEQ ID NO: 62880 - protein, 118 aa, Sorghum bicolor
  Clone ID: 18066713.pep
YDRRGESERALEVFPRTSSYGYSSMQVTDDGYGGLPSYTSKAYEEHLPRDEMTIPASGLSKVMGKRGTNLDNIRKISGAHIEIIESKSSRHDHIAYISGTSEQRQSAENLIKAFIMST

SEQ ID NO: 62881 - protein, 40 aa, Sorghum bicolor
  Clone ID: 18066717.pep
RVAWANESLAHKFTRGFQFSCIDLIASFIGRTNIIVESKE

SEQ ID NO: 62882 - protein, 85 aa, Sorghum bicolor
  Clone ID: 18066721.pep
TCIMGSFAVLYVYTPELYPASSRNTGVGITSSLGRIGSIVSPLVIVGLLESCRQKEAVFMIDLVLFLAGVTCAFFPRETKGCQIQ

SEQ ID NO: 62883 - protein, 49 aa, Sorghum bicolor
  Clone ID: 18066725.pep
NGRREAWLLNNMRQLRHGSRFLKHVCYNTLGQKCSALILHCILCLSFIH

SEQ ID NO: 62884 - protein, 74 aa, Sorghum bicolor
  Clone ID: 18066746.pep
IWVRCKLPCCWGPWPICQLNRRARCKLYCNVVDWWWLWFLCVAIMLDILEARGSLYWIAPPFDDHQELEADCSP

SEQ ID NO: 62885 - protein, 73 aa, Sorghum bicolor
  Clone ID: 18066768.pep
SIEEAGLREMKIMEKWQERPAEIMKEANSAWHKDGTSSAQEDEDAEEAKARAWDDWKDDNPRGAGNKKLTPCG

SEQ ID NO: 62886 - protein, 112 aa, Sorghum bicolor
  Clone ID: 18066769.pep
FLDQHAEGNLVQIIDPQVIEEGGEEVQEVAALAASCINFRGEVRPTMRQVEHTLEGLWGSKKYKREDTVAELEDDSIMTYCPSSTEGGQNVKESSRRYSLEQEMMMSASYPR

SEQ ID NO: 62887 - protein, 105 aa, Sorghum bicolor
  Clone ID: 18066785.pep
VWDRADEFIPERFDLEGPVPNESNTDYRFIPFSGGPRKCVGDQFALLEAIVALAVVLQKIDIQLVPDQKINMTTGATIHTTNGLYMNVSLRKVQQEAELALSESK

SEQ ID NO: 62888 - protein, 121 aa, Sorghum bicolor
  Clone ID: 18066786.pep
RGVAELVDSDLTGSFCFLSSVTSGALASLVSGSWALAMDKDQKKLALPISIYAFLVGYYMCRMMIAWPQACVAAYHVAYAENPQNPQLGTLIPEHLHELEAMAADQDRPRVIHSSDDIDNS

SEQ ID NO: 62889 - protein, 81 aa, Sorghum bicolor
  Clone ID: 18066790.pep
GQYILKSSLICTHTRATTTQTLGGVNYHKVHYERVKMEQKWPMRLWTHPVFYPISYWNCGHKPKECDPIALYVNQYRVIKC

SEQ ID NO: 62890 - protein, 43 aa, Sorghum bicolor
  Clone ID: 18066808.pep
TILTEIFGIKTVNLHLHFLSADTLVTSERFRRKLYYIKLPSTG

SEQ ID NO: 62891 - protein, 115 aa, Sorghum bicolor
  Clone ID: 18066816.pep
THDHRHGTATDCCLLPKWTKNAKCCKPLHCMRAESLDREWRVEIAGKLQCNFALQSHLIWLRPRRAPQGTRRRGRGRSPHRRPTLCHRPTLPRHPLRRRPTLRLRRPTLPLGPFF

SEQ ID NO: 62892 - protein, 74 aa, Sorghum bicolor
  Clone ID: 18066822.pep
KLCSSAQEISFAILGLFGKLTSRDTITENNNPATMLYDEQRTRLPHWTVTSKIVTANEPPQQQLYPCQNTLRRQ

SEQ ID NO: 62893 - protein, 146 aa, Sorghum bicolor
  Clone ID: 18066826.pep
SSNSKPCRRVTRNPVGIDKPMEELLSLLHEVDGEPQQLRVISIVGFGGLGKTTLARAVYDSPHAKETFHCRAWVSTAGATSPEISISQRIKAVLRDILQQVVPKDTMEMDVDSNHLEASLKEYLSDKRCVCVCAPLSPLFQLPSVA

SEQ ID NO: 62894 - protein, 69 aa, Sorghum bicolor
  Clone ID: 18066859.pep
SHIVHLTGLVGVKFLSSHEHSFCTFSGSVLITEDPQGERLCHLLPSSYRWVSLLLIYLAFFFFAFFFFF

SEQ ID NO: 62895 - protein, 134 aa, Sorghum bicolor
  Clone ID: 18066861.pep
AAAIARDDNGHFLGASALVLRGISDPEVMEAIACREGMSLALDLQVVNFRLASDNQNVVKNIRQGSHGVYGQIIHEIKERRFSFASVEIVHERRESNVDAHNIARSALFDDLGRHLWLMSPPYGVCNSYISLDE

SEQ ID NO: 62896 - protein, 70 aa, Sorghum bicolor
  Clone ID: 18066928.pep
TREDIQECFKKGYVCVRAFHRRSRVPLRLCATLHATNTIKKPAGDKPVKRGSTSPEGKRKKNETKASSTK

SEQ ID NO: 62897 - protein, 152 aa, Sorghum bicolor
  Clone ID: 18066941.pep
SGVHGRIFAADTGRPIPGSVMIKGIDSRVSASSTFGDYHRIVAPGETYEVVASMEGFRQKSTRIMLEQEAVNLDFILDPDGTDGQMKLPHNDQGCHCDNFKLFHVQEAHLWLYLLIVSVLLTLYLVFKRKTVSRLASRLLTYRYSSLRRPAV

SEQ ID NO: 62898 - protein, 167 aa, Sorghum bicolor
  Clone ID: 18066946.pep
PVWITQLYAVTKLTLTMTALRKDNLSKLSNLKTLFSLTFTLAAEKQGPDTMAILAKNKLFSDGQIIIPNGGFENLKLLRLCAPLVPLLIFSEKAMPKLERLEVRFKMLEGIYGAENLASLKEVYLTLNDKDGEVITKYIAEEVRSAVKGVAAKESIARIILHIVETD

SEQ ID NO: 62899 - protein, 99 aa, Sorghum bicolor
  Clone ID: 18066957.pep
EKNKSNDNHSTWMWYCNMDYYLHDAKLYGALWYRRMMSKHYPCMACLNVQEPIAKRFRSSTFKYFKLITILVTNPCIRTVFEHSLLSVDASTEQNLASK

SEQ ID NO: 62900 - protein, 118 aa, Sorghum bicolor
  Clone ID: 18066964.pep
TKKVTPSVKLAFHNTEYKQGDVIAYRQTQVTGGGLYNCLVVHCSRFLAYISSISPHACMRRSTNLRLPRRQMTNHFDHAASCFLRALQQQQAQPTFLLAVTTHNLLSSTLSHNTTRQR

SEQ ID NO: 62901 - protein, 83 aa, Sorghum bicolor
  Clone ID: 18067001.pep
QISFNRFPYMYDSTKVIAGHFVNVHVLLGYQSNSPKNTIEDSDCRSAKHHGALSKPRCQCRGPTTPNRLTVSKKKIVITFCLS

SEQ ID NO: 62902 - protein, 75 aa, Sorghum bicolor
  Clone ID: 18067019.pep
STAEAVDSARELALKEGLLVGISSGAAAIAAINVAKRPENAGKLIAVIFPSFGERYISSILFRPIYDSVRRMRKR

SEQ ID NO: 62903 - protein, 92 aa, Sorghum bicolor
  Clone ID: 18067023.pep
ALACIDERAQISKLLHGILNVPWMPHAWAIQQQSGQEKEYNRHIERMKWTRRSRHRCAHIIILYCELSDGCTFSSCFFEEKRIHVGCRCQCL

SEQ ID NO: 62904 - protein, 69 aa, Sorghum bicolor
  Clone ID: 18067048.pep
ERYQLTDGYTRWNGIVKANMLISCGFVFLIRHFNSRSNLVLLKKLILEPVCERTQYSNIHTNNIQETCY

SEQ ID NO: 62905 - protein, 140 aa, Sorghum bicolor
  Clone ID: 18067064.pep
SASSVLLFLREMVLLSPKQACAASSCTRWRLLAMWRPQPMKAGCMAGTLCPSCLTVVWDLGRSRLTTLMPVPLLLATGKIWRKRMALRSATGCNGRVHGLPPPSRYPPAFKYLPYPLVWCEIYYAWYDPFVCTDWSGLVC

SEQ ID NO: 62906 - protein, 167 aa, Sorghum bicolor
  Clone ID: 18067164.pep
MESKIAKIKKGGLANVEAVEELLHLMKLDQTEQRIDLSGRVILADVIAATEKPDILHVFMESKGLLVLDSWLQEAHKWRSDDGSSPKEADKPIGPGEFFLAMLRALARLPINLSALQRCSIGKSVNRLRGHKNVEIQKKSRLLIEDGKRRIDAEMKLGRVWLRTKQN

SEQ ID NO: 62907 - protein, 58 aa, Sorghum bicolor
  Clone ID: 18067165.pep
KNFFTQGASLIQFLNRGPQYLSSFASKPPYSISIPGGSKSIKFLFQRVKIESAMTPAL

SEQ ID NO: 62908 - protein, 186 aa, Sorghum bicolor
  Clone ID: 18067177.pep
QSCHECIIHFDIKPENILLDSSFAPKISDFGMAAFVGRDFSRVLTTFRGTAGYLAPEWLSAIPITPKVDVYSFGMVVLEIISGKRNTPEVFSKSSYHVAYFPVQAIRKLHEGDLQSLVDPQLQEDLNLEEAERLCKVAFWCIQDNECDRPTMVDVVRVLEGLQELDMPPMPRLLAAITERANAELM

SEQ ID NO: 62909 - protein, 42 aa, Sorghum bicolor
  Clone ID: 18067178.pep
TRISSIFTRKTQCASKHNYSLRKLACTAPQIREMRTTIPQGG

SEQ ID NO: 62910 - protein, 94 aa, Sorghum bicolor
  Clone ID: 18067195.pep
MAAGAIPLAYQSSPSSPEWLNKGDNAWQMTSATLVGLQSMPGLVILYGSIVKKKWAINSAFMALYAFAAVWICWVVWAYNMSFGDRLLPFWGKA

SEQ ID NO: 62911 - protein, 193 aa, Sorghum bicolor
  unsure (1)..(193): unsure at all Xaa locations
  Clone ID: 18067199.pep
ISCFNELLCVLLYTFVFPTLPIVKFYRLKAASEGSKTVAGDLAAAGVPIQHEEQAMEDPKQYVRLSTKLLFLQNVDYALDIFLTYVLTLSIFPGFLSEDTGSHGLGXATLARFLLIPAFYFTAKYGAQGYMIFLTSFLGLSNGYLTVCILTEAPKGYNGPEQNALGNVLVVFLMIGLFSGVVLDWLWLIGKGW

SEQ ID NO: 62912 - protein, 42 aa, Sorghum bicolor
  Clone ID: 18067210.pep
DSISNSNQHSIPQICHKGKKVPFAGEYSLLLSSKITLRMFCK

SEQ ID NO: 62913 - protein, 61 aa, Sorghum bicolor
  Clone ID: 18067218.pep
LGKGTAYSDRGEQAILQGDSEIAEAWFDQAAEYWKQAIALTPGNYIEAQNWLKITKRFEFE

SEQ ID NO: 62914 - protein, 87 aa, Sorghum bicolor
  unsure (1)..(87): unsure at all Xaa locations
  Clone ID: 18067235.pep
AKAKXSLPLTHPPIHTPKENKTIMLTLCDFLHILVEYILLLHADLISLLHLSDSMQLLPLGLGFVRNNQFATNCCHCCCSGGVLYIL

SEQ ID NO: 62915 - protein, 135 aa, Sorghum bicolor
  Clone ID: 18067238.pep
GSKRPKIGDSPPLRQRNRSFDMALPCNRTDTEAIDRVKEDQSLDEGKKLQEQQERTPILEKSVNSWIGRWCQGGTPVYHEDPGQGRQGTKPGRSSEELEGQFPSIAAMAMMGRAMNKLRPCEHQKKGPFVVWKTD

SEQ ID NO: 62916 - protein, 192 aa, Sorghum bicolor
  Clone ID: 18067263.pep
EGDPVDEMHFILHGCLESVTTDGGRSGFFNKVQLKEGSFCGDELLTWALDPKSAANFPVSSRTVKALTEVEAFALCAEELKFVASQFRRLHSRQVQHTFRFYSQQWRTWAACFIQAAWRRYYKRKMAEQRRKEEEAASRPSSSHPSLGATIYASRFAANAMRGVHRLRSKAVPTIVRLPKPPEPDFGVDDAD

SEQ ID NO: 62917 - protein, 122 aa, Sorghum bicolor
  Clone ID: 18067269.pep
NSVEVPCPDSAAGLYIRTRDNQVVKVVFDEDQLAYQIGETTEILSRGYLCATPHCVQAPNSENASNVDRSTFALFMQPDWNEKLKFPSEIPYHQELIPPNGTLTFGEYSERPSKHSITQTTT

SEQ ID NO: 62918 - protein, 108 aa, Sorghum bicolor
  Clone ID: 18067275.pep
TLQEGISKLEEFLQAANITLLKFRSVLFACVPKATEVVAAVLIVTAAFLVFVPSRHLLQMLLLEMYTREMPLRKQNTEKFRRRIREWWARIPAAPVQMIRPNESKKKR

SEQ ID NO: 62919 - protein, 62 aa, Sorghum bicolor
  Clone ID: 18067277.pep
NQATEDLQALEYHEMAAEAYYLKAMAYNHLGKLDEREEAAARFKDHVTALENPQNEEDSLAY

SEQ ID NO: 62920 - protein, 84 aa, Sorghum bicolor
  Clone ID: 18067286.pep
LHRGGDGLVREIEFRRPIVVSILFERRVHAPRGLKGGRDGARGANYLVRKDGRKISLGGKNTVSVSAGDIFQIFTPGGGGFGFP

SEQ ID NO: 62921 - protein, 161 aa, Sorghum bicolor
  Clone ID: 18067291.pep
SRCPIQEVPWSFFYYSKGKTIELPNLREEFEVHLATDVAFRLQPRQLNETTAVARLRTKLLVSNGRFQLASAEKQSDQSKRHLLHCSTIDPGRLLSALQEKGMVCSFAADDSSTASECSVLITSPGDALVKITSDRTVIYCDNERTCNQIYDALSSVCKGI

SEQ ID NO: 62922 - protein, 58 aa, Sorghum bicolor
  Clone ID: 18067304.pep
GGADHPFLIRGPLSPLPHLQACFNSGNMRFVLQLKPLQRNYCLGCSPHLIALLMLWEY

SEQ ID NO: 62923 - protein, 121 aa, Sorghum bicolor
  Clone ID: 18067305.pep
PDGIEKMVTYIMKRYNNLPMFITENGYAQGGVGYNQVEDWLDDQSRIQYLDGYLTKLAKVIRDGADVRGYFIWSLIDNFEWTYGYTLRFGLHYVDYQTQERKPKSSALWYKRFLQSLHEAQ

SEQ ID NO: 62924 - protein, 110 aa, Sorghum bicolor
  Clone ID: 18067307.pep
TGELTTESDVYAFGMVILQMLTGLLDLNIAEQAREAVKMDAVHSVLDASAGPWPEVQAEKLMKLALRCCSLERKRRPAITSDAEWRSLDILRAMATPSSKASWKWNSHAS

SEQ ID NO: 62925 - protein, 79 aa, Sorghum bicolor
  Clone ID: 18067342.pep
TGNSQEVQFLGEVIHPFDAQADGELSLAVGEYVVVRQVAANGWSEGECKGKAGWFPSAYVEQRDKAPASKVIEPGLLTT

SEQ ID NO: 62926 - protein, 143 aa, Sorghum bicolor
  unsure (1)..(143): unsure at all Xaa locations
  Clone ID: 18067357.pep
CVTNINNCTHTAEVEEDAGQDWGEVVMTIAHLLNHLPTKSFQGNTTYEAWHGHTPSVSYLKVFGCIAYAKDLGQLXKLDDHGKLSVFISYAERAKAYWILDPVKQWVKLSRDVVFDEXGGAWDWSTSGIGSSATAGTEFTVMY

SEQ ID NO: 62927 - protein, 35 aa, Sorghum bicolor
  Clone ID: 18067376.pep
KLRLQINKYSSNGCISSSPFPKIPYFDLRRGVTGT

SEQ ID NO: 62928 - protein, 50 aa, Sorghum bicolor
  Clone ID: 18067388.pep
YGTIICSLYMLLSSSVQYMHMLMMFCRWISGIHVYLLILFPTSNKILYVL

SEQ ID NO: 62929 - protein, 53 aa, Sorghum bicolor
  Clone ID: 18067415.pep
FQGKQMAYFWMTMAFIQIFTVVECMRCALSGVYANIPFISHAAFIHSDLNLFR

SEQ ID NO: 62930 - protein, 38 aa, Sorghum bicolor
  Clone ID: 18067431.pep
SNRAPILIKFIATKIYPNISTVPCISVQCTFGATLLWL

SEQ ID NO: 62931 - protein, 59 aa, Sorghum bicolor
  Clone ID: 18067438.pep
VLLVSQRETEIRLHHIASHYVWRSKFFFFFFTWCRISPSRCYGLKYLWGISTRSVWTLE

SEQ ID NO: 62932 - protein, 59 aa, Sorghum bicolor
  Clone ID: 18067479.pep
AKDADLLILEGMGRSLHTNLNAHFKGDALKLAMVKNKRLAEKLFNGNIYGCICKFEPVF

SEQ ID NO: 62933 - protein, 44 aa, Sorghum bicolor
  Clone ID: 18067499.pep
DPTNEKLEKETHIYKFYLVRILNYSSTKKNSSDPKQKDTYPTDT

SEQ ID NO: 62934 - protein, 182 aa, Sorghum bicolor
  Clone ID: 18067504.pep
NVCNREFLPADSPWTCPYDHLFYDASVLWGLIGPRRIFGDLGTYSAVNWFFLGGAIAPFLVWCTQKAFPAQKWIRHVNVPVLIGATSLMPPGTAVNYTTWILIAFLSGYVVYRYRRNWWERHNYLLSGALDAGLAFMAVLLYLCLGLENKSLNWWGNDLDGCPLASCPTAKGITVDGCPAHN

SEQ ID NO: 62935 - protein, 113 aa, Sorghum bicolor
  unsure (1)..(113): unsure at all Xaa locations
  Clone ID: 18067505.pep
EDRYLLEFPFTFARYTETALQQKVCQWINVCCLPFGVSIPRISHKVNERDELASLKEFAVETGSQFEMCFPLAFFDVMVHLVVHLVSRIEALSPMYLHEVWMYEXFMSTLNGY

SEQ ID NO: 62936 - protein, 48 aa, Sorghum bicolor
  Clone ID: 18067530.pep
LQNYTRAMSPKNNLNCGTKVAYLYSHGRNGTSWTGFSFSSRKDSPNLQ

SEQ ID NO: 62937 - protein, 110 aa, Sorghum bicolor
  Clone ID: 18067555.pep
NKRSFVGLWRSSNTVDIKKMGSNTLNGRSSNARMSNVTESPDLKNSEVCDSPHITGQWRPDLLNPDIVRAIKGCIDWPRGVQKHSLKSKILEARIDGSKVQLRQALKQKI

SEQ ID NO: 62938 - protein, 124 aa, Sorghum bicolor
  Clone ID: 18067567.pep
LNYSDTKTDDSIPTIHFSQYDHPYFTEIQNICFCRIPYYGKNPIFIPNLNPKICIFLDNGPNGGRMLTIFQHGVRMLTIFQLGGRMLTIHCPAWTTPNVVCQRSPSVTIIACLHVTIYMNNQLL

SEQ ID NO: 62939 - protein, 171 aa, Sorghum bicolor
  Clone ID: 18067583.pep
PSVRLACTYKHKPVADEVARRSRRFAAGLLWLWKLTGRGRCGSSRCVSFLFVCGSGRTGRVVEAGVNNSRRHPSLQQMMASNSGVQWSGGGEVVVVALHLLSRRTAAANSRCTALHCTVAALSCLPIGAMVLSAGSNHVWWDKVPAVFSNEGYNTKRLLLPSIADVWSRWD

SEQ ID NO: 62940 - protein, 155 aa, Sorghum bicolor
  Clone ID: 18067597.pep
IEAVESCIEIWRSSHSGKYSILFVLDIISSLFSGRIVWEKVSPALQRAVQSQMSLMSTPFIDNNDLFETGSTGGMSRDLIDRIPKMRFSAASNCDQETDSSCCSVCLQDFGAQQFVRALPQCQHIFHVRCIDNWLLRHASCPLCRAGVHIDHIHM

SEQ ID NO: 62941 - protein, 50 aa, Sorghum bicolor
  Clone ID: 18067617.pep
SSATPPKRTWTSTLGVGVIGYRGGLHNYLIPGLLGGVSSDAFSWRGPTPW

SEQ ID NO: 62942 - protein, 209 aa, Sorghum bicolor
  unsure (1)..(209): unsure at all Xaa locations
  Clone ID: 18067619.pep
MLLWCWHARNKVNQGERRCVIEEICNSVYYHLTCMHKLKLSASTPTRHQQERWSYFPNTRKGGWGCIIRNHKGECLAAGVGALQGLSNAXAETLACRKASELATSVGVGIQRIIIELDAQNLVSALMSDTYDRAELGACFKETRSKIACDFXIYCNVSKCPRNCNAVSDCQADYGASLSDVQFKLWIDQDTKPCNPTCIRESTCFCMLN

SEQ ID NO: 62943 - protein, 69 aa, Sorghum bicolor
  Clone ID: 18067624.pep
DFCKLMYSLLGLSTVYYLSYYASISCILLRTPRSCPKFICRSIYVIARSTYAIRTNILQYAWNLICYHV

SEQ ID NO: 62944 - protein, 83 aa, Sorghum bicolor
  Clone ID: 18067647.pep
FQAILQSHTPFLIWASSIVLVKMYYNADCITMNPITASSEMTQMVAVAVQGQQTRKPPYGGTVYHEPMPPGNILQNRDFVQVN

SEQ ID NO: 62945 - protein, 50 aa, Sorghum bicolor
  Clone ID: 18067660.pep
SKVRFFFFGLIPNEEGAGNDAVASFFVKCYVRSDGNESFDLLILSCSYLQ

SEQ ID NO: 62946 - protein, 89 aa, Sorghum bicolor
  Clone ID: 18067709.pep
YQEFNGMTPHVRRMSFECDDTKSHTIDFYSLVSTLEISGGLLTPSLIFPIRSLKDRTSHTNVLITVPYCLLKFKQKTSNAYQSSVCTIL

SEQ ID NO: 62947 - protein, 78 aa, Sorghum bicolor
  Clone ID: 18067712.pep
SSHIIFIGRLAKQDSEYETRTIIHLHGWLNCLHCSSTSAFLLPLLLLPLFTWVLDSKHLSCTDHLTSFIITFSSSISS

SEQ ID NO: 62948 - protein, 60 aa, Sorghum bicolor
  Clone ID: 18067734.pep
VPLRNQYQQLYPSWFVACTAPVLVSRKNLQTKCLVEIVVVIRKLSMYLRSPRHAFDDELQ

SEQ ID NO: 62949 - protein, 144 aa, Sorghum bicolor
  Clone ID: 18067751.pep
LNRPKDAAEKLSVYIRDGNDIELPYNVENSEKALVERDSDGEDSVAPSVTKLATEESEHSESLRPEEARGVLYIDLGMTAAMQGEVEQANYMVSRGLAMLPNNPRAVLASVYIDLLQGKSQEAVGKLRQCRNVRFRPGSIAASS

SEQ ID NO: 62950 - protein, 61 aa, Sorghum bicolor
  Clone ID: 18067811.pep
KYSSETRKHIGTRKHPDRTHIPTEEISFTIHNNTIEKYLLHQLVASPANCYLLIGMRGPWR

SEQ ID NO: 62951 - protein, 164 aa, Sorghum bicolor
  Clone ID: 18067845.pep
MYDKQRTHESTEKVAGTFGYMAPECTSGRKFLLSIKSDVYSYGVLVLEIITGHKIYTFEGQDSEGLVEYVWQHWREKRASDVVDGDVVGVEAGQEHAARQALRCVHVALLCVQSDRARRPAMGQVIAMLSSDDAAAEELPEPTLPGYVVRPTAASGVQLCFGCR

SEQ ID NO: 62952 - protein, 102 aa, Sorghum bicolor
  Clone ID: 18067863.pep
LSYLAIFVMLICITEREALITDPLNFNVFNILFEVVSAYGNVGFSVGYSCKRLLNHDVYCKDASYGFVGKWSGKGKVILIIVMVFGRLKAFNMKGGRAWRLR

SEQ ID NO: 62953 - protein, 83 aa, Sorghum bicolor
  Clone ID: 18067881.pep
KSCCGTGPWSCLFESVRIHWGYWNQGCRRTIMPRLIAISREKAVCRAGVPSACKTCSFTNCKKEKEGKFLTFVHRIVRFYFAN

SEQ ID NO: 62954 - protein, 49 aa, Sorghum bicolor
  Clone ID: 18067928.pep
NFYWWDICELVVLLSNGYILLQKQSSAYIYPFKYVYVFLRSTFATHNTP

SEQ ID NO: 62955 - protein, 113 aa, Sorghum bicolor
  Clone ID: 18067939.pep
TGEKPTHVSSAPENFRGSLVEWINYMSNNALLQDAIDKSLVGKDADGELMQFLKVACSCTLATPKERPTMFEVYQLVRAIGERYHFTADDDLVLPPLSTDGDGVTLDELIVAK

SEQ ID NO: 62956 - protein, 67 aa, Sorghum bicolor
  Clone ID: 18067940.pep
NAKTIKPDKRKLVLSFDDPNIRWDQFKQNMQEILHHSDMKSIAFRKPNDSVYTFPMPECMCQQDGMI

SEQ ID NO: 62957 - protein, 80 aa, Sorghum bicolor
  Clone ID: 18067944.pep
LDDNAKQATGVGTEINCLRREELLNCISSMSKSAERLRLGLDSLSKRVGDFFQIVLTGRDALLCNLRISDGGKVAAEVRS

SEQ ID NO: 62958 - protein, 142 aa, Sorghum bicolor
  Clone ID: 18067947.pep
IYGHIIGMFEMNNLDLVVASPVEDYFIHIDDLPESEKEEAEKVTGPFLDALGEDYSVPCEGTAFFPLQSCMNHSCCPNAKAFKRDEDKDGHAVIIALRPISKGEEITISYIDEDLPYEERQAQLADYGFTCTCLKCQEEQPV

SEQ ID NO: 62959 - protein, 159 aa, Sorghum bicolor
  Clone ID: 18067955.pep
RHKIRRSPQAAFDIPDTSALAEDETSSLVCSSGFRSPNEIQNQHQSTSKRPIEHLENQPFLHLFHQAEDDSMQQVQHCTQFPPIHQCTSNPHLSDNPQHQQQAYLSQQISCLQVGQGHLGGRMHIVPTSPAKFCDECGSPYLRATSKFCSECGTKRLGM

SEQ ID NO: 62960 - protein, 35 aa, Sorghum bicolor
  Clone ID: 18067959.pep
SGQGVFSPLFTGTSLQNLAANNQSGQPCAKKGGNG

SEQ ID NO: 62961 - protein, 167 aa, Sorghum bicolor
  Clone ID: 18067960.pep
VAPAARRFLGRAEAFTPLQLMGLGHGAVIAAVALAACAESRRLANVRAGAALLGIAWLLPQYVVMAVSDASLSVGQLEFFYDQAPETMRSASTAFYFLSCSLGNLISSQLVTLVASVTEMSGRTGWFPPNLDDGHLDYYFMLIVGINAVNFAVFVYLAKNYTPKRVR

SEQ ID NO: 62962 - protein, 181 aa, Sorghum bicolor
  Clone ID: 18067974.pep
SVDIPGMADEKSIAKTFMPPETWLADGDARPDYDYSTKSHMAVCLSCIACGPEVVFSPVVLQDIDSIGRHIVGTARGRWIPSQTKQTLRKDWGVWLQLQCLDVVPFLCFGLPLGRSSVNIYSWMDEHNFFARLSSPCLIQDGRQGERGGSRVHCWIGKISWRGVHILDSFHLFITYHHHHS

SEQ ID NO: 62963 - protein, 205 aa, Sorghum bicolor
  Clone ID: 18068003.pep
LELIAYTIWNALKYSYAFEGIAEQLKKERLEQLALKSGQASDEVTPLDADIDRSNFDSSDQSANVNVASGSGAGFMSEAALISSIHLEDKTQTISSVKTSETLSGLIRPANKDVLSTSAGTTLVEASLLGHSATVFDAVMLCRSTLALSLPPDNGKATSLNLSATTTVRHGEAVPLPCNANIYIYTRTLIWRFYKRFFNTCVLSM

SEQ ID NO: 62964 - protein, 69 aa, Sorghum bicolor
  Clone ID: 18068038.pep
KKSWVPKLVKYSTFSAGMMTPGRTKNNSTDGLHMSDYQSLHGGGIASPGFLSMLSPRRLFSPRRNSTKH

SEQ ID NO: 62965 - protein, 78 aa, Sorghum bicolor
  Clone ID: 18068045.pep
SSSEQLGCSTAVPDTDSMNAAQARHSQNHLNLVHSRKQVVPLPHSMALEARFARLSQLPQTTHKATPQLTTCAARRLP

SEQ ID NO: 62966 - protein, 94 aa, Sorghum bicolor
  Clone ID: 18068047.pep
ILCMSIGMMQLKLLPFFFFPFEAQISLYSFGSWMGHHQKVKKGDFSALVKRMMVVLLDTNILFFFLFECLKKYIISRLLYYGSLLSAAKKEYRG

SEQ ID NO: 62967 - protein, 145 aa, Sorghum bicolor
  Clone ID: 18068048.pep
NGSSLIVMSKGTPYTQQSYKVSESFPYKWINKKWKEGFHVTSMATAGNRWGVIVSRNAGYSTQVVELDFLYPSEGIHRRWETGYRITSIAATPDQAAFILSIPKRKPMDETQEILRTSAFPSSHVKEKWVKNLYISSVCYGRTVC

SEQ ID NO: 62968 - protein, 57 aa, Sorghum bicolor
  Clone ID: 18068061.pep
DHFMPHNTIEFLGKATVPSLSKETPPPPTNDTERKIYRGKAKKCWHQGIGCELQQTG

SEQ ID NO: 62969 - protein, 87 aa, Sorghum bicolor
  Clone ID: 18068081.pep
TRSKRSRSHLFYGAKNKQDCTHEHRENDHRLQRAQLEFWGSWIYIVGQKHRRGSDDEPAPEGLIFARVHVDASNNDAPISNLLIYKW

SEQ ID NO: 62970 - protein, 84 aa, Sorghum bicolor
  Clone ID: 18068113.pep
YGLQKCFRMTRRMLSDQENVSFVISYLFVQGSALELPGFYCPPQIVLHPCLSSTSLLAYSLLEVQNLSVHLSHHLICLHLISPA

SEQ ID NO: 62971 - protein, 144 aa, Sorghum bicolor
  Clone ID: 18068124.pep
RFQDSIDIVLATSFLQEFVEARRTAALNNVPSCMWSPAPPHELKGVSADALNANAGFVTFVVYPRHVEGKKLDRTVWNLLTFHAYVSYHVKCSEGFMHTRMRRRVESLIQALDRAKSDAEKLKKLVHGGSFQRLSLKNEGDSRS

SEQ ID NO: 62972 - protein, 75 aa, Sorghum bicolor
  Clone ID: 18068133.pep
ELEGPASSIAASLRKKGRSVDLVEDKRLKWVFKHAERINASRLILVGNSEWERGMVRVKILSTRGEFEVKAGELE

SEQ ID NO: 62973 - protein, 102 aa, Sorghum bicolor
  Clone ID: 18068167.pep
DNPSLMYIGNSGLCGPPLKRNCSTNDSSIHTNHRSNRKEFEPMSFPFGLGLGLVVGLWTVFCALLFKKTWRIAYFQLFDKLCDRIYVFVAVKWASLTKIDED

SEQ ID NO: 62974 - protein, 88 aa, Sorghum bicolor
  Clone ID: 18068168.pep
QCAQNVIACEGLDRVERPETYKKWQLRNHRAGLRQLSLDPDIVKAVQESVRDKFHEDFVTDVDLQWLLGGWKGRILYAMSTWAAADAI

SEQ ID NO: 62975 - protein, 152 aa, Sorghum bicolor
  Clone ID: 18068169.pep
TPSHYACMIDMLGRNGRFDEALHMIKNMPFEPDVLIWKTLLASCKLHKNLDIGKLATDKLMELSERDSASYVLMSNLYAMHEEWQDAERVRRRMDEIGVKKDAGWSWIEVKNEVSTFVARDTSHSDSASIYQMLAELVVVMQDTELDVHMQI

SEQ ID NO: 62976 - protein, 102 aa, Sorghum bicolor
  Clone ID: 18068197.pep
LCKHFFFCRSGYILWCPLFFNSRRSVEDIIFRAKSSFLQVWIRLSVAPSTSVVLIRAGAFQQFQFSTIIQDIIAELFFSSWSVELSTPQNEILRQVCHLRYR

SEQ ID NO: 62977 - protein, 130 aa, Sorghum bicolor
  Clone ID: 18068245.pep
QRLHSFELQLGTCEYSTITLHHGPGIARQKKFSSITFTMLESPLPLSRPTVTQSLPLLAQPCSSLQNHNLRSHQHPYSQTDLGRYPSSLAQRPSRVPLGTASRQSPVDKLSCKISFSALQELSLASVCFV

SEQ ID NO: 62978 - protein, 68 aa, Sorghum bicolor
  Clone ID: 18068255.pep
MPKGIPVATVAIGNAENAGLLAVRILAARDPELWDSVTKYQNDLRDMVLETAERLEDLGSQEFLKGMA

SEQ ID NO: 62979 - protein, 148 aa, Sorghum bicolor
  Clone ID: 18068265.pep
GRPDRTGLRMSNELAALGIPVKVLIDSAVAYSMDEVDMVFVGADGVVESGGIINMMGTYQIALVAHSMNKPVYVAAESYKFARLYPLDQKDMTPAHRPIDFGVPVPTGVEVETSARDYTPPQYLTLLLTDLGVLTPSVVSDELIQLYL

SEQ ID NO: 62980 - protein, 98 aa, Sorghum bicolor
  Clone ID: 18068332.pep
YYTMFTSLTILASVIMFKDWDRQNPTQIVTEMCGFVTILSGTFLLHKTKDMVDGLPPTLPVRIPKHADDTAEGIPLRSAAEGIPLRSPRATESFRSTL

SEQ ID NO: 62981 - protein, 64 aa, Sorghum bicolor
  Clone ID: 18068335.pep
RKGGDYEGGGGGYDGPRKEGGGYGAGGYGGGGGGYGGPREGGGGYGGGGGYGGNRGDSGGNWRN

SEQ ID NO: 62982 - protein, 105 aa, Sorghum bicolor
  Clone ID: 18068350.pep
EIASVGIYWGSNWVTIYLSSPSWDHQFFFSKDFDFNAHRRRRERIFSLVTNANVIMFFAVDCWATLGLTIEDSTNPFQTITSFRKSVSHSFPCVGPSRRLEMMRS

SEQ ID NO: 62983 - protein, 89 aa, Sorghum bicolor
  Clone ID: 18068372.pep
AICSYFFYTIQSQKWPTLCSLPTIVYIWLLLACSSRSLDNTVPSFPVQNIRISIENLNPQPQLLSFCFCALQLQVTAFKPMSWYKKIIT

SEQ ID NO: 62984 - protein, 46 aa, Sorghum bicolor
  Clone ID: 18068376.pep
QPFLSSTNYILFYISRTTLYTRGKKNHWDGPFEEAFRKVLFLLTQL

SEQ ID NO: 62985 - protein, 123 aa, Sorghum bicolor
  Clone ID: 18068413.pep
LKSDPSPFLFSSAPILPLLSPVYVTYMSKTTIMGSRGFQMVPEGTTTLAPRLQITCTIELAIRICQREWRLAVQTQYSFVNSAFWLGSPSLNASLSIRTCKELIVLTKDAQIKGAQQKAYAKT

SEQ ID NO: 62986 - protein, 67 aa, Sorghum bicolor
  Clone ID: 18068418.pep
VHTDAWYNAPAASQVAAIWTHGNDPQKCFDRSVIVYPKGEKMHYIKAYHCFYDPLAYPIFNLRGETG

SEQ ID NO: 62987 - protein, 53 aa, Sorghum bicolor
  Clone ID: 18068442.pep
ARLPNIYAAREMRFLSAPHVIISPMLLLDEPPSEILYTYCQKSKIKILENLYV

SEQ ID NO: 62988 - protein, 106 aa, Sorghum bicolor
  Clone ID: 18068480.pep
HLSYLQSLPSRDTAVEKLAIAEFHLNKLLHQKEMQEIKRWWMDLGLAQEIPVVRDQVLKWYMWSMTALQGYSFSRYRVEMTKIISLVHVVDDIFDLVGTLDGALSL

SEQ ID NO: 62989 - protein, 70 aa, Sorghum bicolor
  Clone ID: 18068490.pep
ESGSGASLGSGDEDESKFDKGRPRGRKHEDKEEKRQHKLAVKEAKREKRKEKIPKSVKKKLVSASSRKKH

SEQ ID NO: 62990 - protein, 114 aa, Sorghum bicolor
  Clone ID: 18068513.pep
STTLHQIQACQPAPSLALRSQPPWAARGMGELSPVHHNLVQQPSSGTVDWGRWIVRRVARGRRPEVPWIGTSPKESLHKFSCPIVCNVASIQKLVDWFLHRRHARPLEKFPKVR

SEQ ID NO: 62991 - protein, 29 aa, Sorghum bicolor
  Clone ID: 18068581.pep
PPIFYILLNCNQSHFQKGGPKMTPQQLIT

SEQ ID NO: 62992 - protein, 98 aa, Sorghum bicolor
  Clone ID: 18068582.pep
WNTVIQTHMRSVPKRLFSRMILMYDIHQRPDKVLEIYTDMEELGVRPDEDTARRIGKAFVAFGQEEEEKHVLEKYLKKWKYIHFNGERVRVRRDGPLA

SEQ ID NO: 62993 - protein, 46 aa, Sorghum bicolor
  Clone ID: 18068599.pep
FWVKFDTLSKVAIASGFQVVMFSEGKMLLDFAAPVKIFVDLFELIA

SEQ ID NO: 62994 - protein, 84 aa, Sorghum bicolor
  Clone ID: 18068618.pep
EAASLINAIESKIRSGGAIIAKVPSSNLTSPVPPSIAMSSSSEDEEHDPSEPLMVDIDRNFNQQSSDEMKLQSEPSESETEADN

SEQ ID NO: 62995 - protein, 112 aa, Sorghum bicolor
  Clone ID: 18068636.pep
YREVIRRAPHEFKIACLEDIKALFPSDCNPFYAGFGNRDTDELSYKKMGIPKGKIFIINPKGEVAVNSSVDVKSYTSLHTLVHDMFPPTTLVEQEDYNNWNYWKVPLPDVDL

SEQ ID NO: 62996 - protein, 42 aa, Sorghum bicolor
  Clone ID: 18068638.pep
EQDFWSYFCWIITSGLRIGLSHMSAITLDDMLHSTSFPALPA

SEQ ID NO: 62997 - protein, 147 aa, Sorghum bicolor
  Clone ID: 18068647.pep
NDSKMLPTFLRCFPNVERLHIVSKKNDEIAGKINLKFWQEAGPIESIRSSIKMMTFREFRMERSEVAFLKFFFQSAHVLKNAVIVGSNGSFTSIPEVIDKVKTLIPQDGPSNSCHVLVYESSDPAGGPVLSLQKGFDFSVSDPLNYQ

SEQ ID NO: 62998 - protein, 36 aa, Sorghum bicolor
  Clone ID: 18068706.pep
EAFSLKAVGNISLGMGNYPAVFPYLYKLIILSHSLW

SEQ ID NO: 62999 - protein, 67 aa, Sorghum bicolor
  Clone ID: 18068719.pep
SIFMCILAGTITVQFILVQFLGDFANTAPLTQLQWLVSILFGLLGMPIAAAIKLIPVEPHEDNRRIS

SEQ ID NO: 63000 - protein, 129 aa, Sorghum bicolor
  unsure (1)..(129): unsure at all Xaa locations
  Clone ID: 18068758.pep
DTGRHPNYLQXGVAGNSRHDMNEIKQDHLHQGLSTGGFNHNFGACMTEQPNPNVSYLMPQVKPNTMASEDKLKQRNAYDLGIPKLNGGFSSSSCNFDGLLNSMIKAEKDDLSFTDNDLGCDFFPLGACI

SEQ ID NO: 63001 - protein, 40 aa, Sorghum bicolor
  Clone ID: 18068764.pep
KKKDATMLKWLHITPEISITPGDHQIAIIIGFAIILILNT

SEQ ID NO: 63002 - protein, 149 aa, Sorghum bicolor
  Clone ID: 18068773.pep
RWRQMEAQEQEMEEGKGKPTEAEGSETKIPNSKKVLKFIPTSSINSDGSVEDWSNFVYLNDHVKLVYDRRCQKTGYGKLYGAKELLVVWQNALTHILEDSLAEGKLEFYDEDVVNMLEFVLPGVFNLFQKGMHSIGHEELPHLMRIMRM

SEQ ID NO: 63003 - protein, 191 aa, Sorghum bicolor
  Clone ID: 18068774.pep
FIISDIKPYVDCFEKLYVTWPDHVAQYNLLWYLARNRKHRSLRICRDYIDEIWCMKPCRSSRDITELVFDHVVVHGWTENINDAATFHEFNNNRGQLAIQREGCTGAMPLESLRRPFDESLILWHLATDFCFFDVDAAGKSASCGHGDGGVDARRRRSRMISNYMAYLLFANPEMLMPGSRRSLLKDAYKE

SEQ ID NO: 63004 - protein, 70 aa, Sorghum bicolor
  Clone ID: 18068779.pep
SPLLVTPKSTSSWYQWLSCSEAFMISVSSQKYTSVIDLYRLSPMLIRDQLFQVIKEQPYQSDSSQVLPDD

SEQ ID NO: 63005 - protein, 105 aa, Sorghum bicolor
  Clone ID: 18068788.pep
EEPEVMLDAHVQAAFIVGVPFSKSGGHDFRANNITHSVSNLGATMLKHRLTPPPDEVYSLHRKLSGAFLACIKIGAVVPCREILFQVYEQYNFSDHHSDVASSAG

SEQ ID NO: 63006 - protein, 81 aa, Sorghum bicolor
  Clone ID: 18068792.pep
QFQEYMLAWSTPWGFYYRNKAYVETRGGFNYFQRRWEEIYVKLVNSDYSSKTQSGGCEIEAQIDKGDSPKYIATIKLEHGP

SEQ ID NO: 63007 - protein, 71 aa, Sorghum bicolor
  Clone ID: 18068793.pep
WKPKTEDELTEERAKQKTKEYIYGSSSRKKANGKHGNSSGDDSDGDSGGKNKKAKTTRFTHAVKGKGKSKV

SEQ ID NO: 63008 - protein, 54 aa, Sorghum bicolor
  Clone ID: 18068825.pep
SNTKSLLPLVHNETKNFYYHYSMEDVKGYVMSRDTPITMPVSSGACMLKSIQQE

SEQ ID NO: 63009 - protein, 33 aa, Sorghum bicolor
  Clone ID: 18068842.pep
HYGISGRIPKGPAPFNLEVPTYSFLEENKLLIG

SEQ ID NO: 63010 - protein, 85 aa, Sorghum bicolor
  Clone ID: 18068848.pep
VTNNLPILFGGLGMIMRSPFSICSSCRSAFALPSMRISAVRTIHLVDGANSFFFLLGGPFVMSLIFQMRFMFSKGKDNFQIGIQT

SEQ ID NO: 63011 - protein, 84 aa, Sorghum bicolor
  Clone ID: 18068857.pep
EQNLLSPRLSVKKLGRAMQLSGAFCFKTVSSSSCWAALQNVAAFTKFGACGSVQFFLMLTGPGSSPGFIVDEIEHVRPQNGFFG

SEQ ID NO: 63012 - protein, 86 aa, Sorghum bicolor
  Clone ID: 18068900.pep
KADADYGGAAPWQWHQQLHHTLVPVCQPVMVPTAKSTPLQPRPSNLQSLAAEAELLARCCLNLDAFSGTGNRVVSYSSMCGYLLYY

SEQ ID NO: 63013 - protein, 150 aa, Sorghum bicolor
  Clone ID: 18068954.pep
DSRPKRVDDSHKTGNSTFEHHSRSEQGSGEQTRRESEHGRNKGPSFNRRRGGVPHMSEEERLARLRQMEADAEVHEEQRWKRLKKAADDDAKEAATVNVNQFKGKNFLEDEKKSIFGTDKGGSATIEESIRRRAFYSQGGRDAEGNPFRR

SEQ ID NO: 63014 - protein, 136 aa, Sorghum bicolor
  unsure (1)..(136): unsure at all Xaa locations
  Clone ID: 18068956.pep
YAXDGICSIKSDVFSFGVLVLEIISGKRTTGFYQYDGKLYNLISYAWKLWRAGDWYQLVCCPIGNDHEAIQRFIQVALLCVQESAEDRPTMDHVVTMLNGDNVSLPKPRQPGYFFVRSNESEAQSSNFSISITLER

SEQ ID NO: 63015 - protein, 192 aa, Sorghum bicolor
  Clone ID: 18068970.pep
KMSKDNADDSNDDDESELVRITSKLQEIDPTFVSKSEAVQLTPEPPKVRPLTAEDYRIAIGIERFRCPEVLFQPGMIGIDQAGIDEMVSISLRRLMEDESVKERLCQSILVTGGSSLFPGMIPRLESGIRQYRPYLAPLKLVRAADPILDAWRGAAAFAASSKFGKQTFSLADYREHGENLFHRHNHCLLTN

SEQ ID NO: 63016 - protein, 140 aa, Sorghum bicolor
  Clone ID: 18068972.pep
DIQQVKADAVSLANRLEALEKTKRKFLGENLEECSIEELHNLEVKLAKSLHVIRGKKTQLLEQQITKLKEKERNLLKDNKELRDKRNLQPPPEAPPVLNRCLPPWPRNLPAPPSNDDMDVETELYIGLPGRERSSNRDSG

SEQ ID NO: 63017 - protein, 77 aa, Sorghum bicolor
  Clone ID: 18069006.pep
YSLQNQKKYTCMQWHPSYIWMAKTMGATSRDLILYINQNNPQILGGGITLQFILPLDSLWGLQLGNLPLLILASFCK

SEQ ID NO: 63018 - protein, 103 aa, Sorghum bicolor
  Clone ID: 18069012.pep
VGRLIGMLFPGDIEVLKTPISKSAASNISAAAAAAVLLHQQQQLLLQQQHMYMQQGLLHQPEMQPMKHQHESRRAAPAIAATADDAREILVEKGRAKVAKQDA

SEQ ID NO: 63019 - protein, 55 aa, Sorghum bicolor
  Clone ID: 18069014.pep
LLRLWSQCKDLIRRTLFLSADSCTWRKRALFMTADKPETNCMKPSCHHIKAHIVL

SEQ ID NO: 63020 - protein, 59 aa, Sorghum bicolor
  Clone ID: 18069019.pep
LLAKIDSCCQSIVRGNFSEISQRMHLMPSSLQIEVPNFFCTHQYGLLPPPKGKVFDPDI

SEQ ID NO: 63021 - protein, 31 aa, Sorghum bicolor
  Clone ID: 18069022.pep
NILKHNLEAPKIVMLHQIRLEQINPSLRIIS

SEQ ID NO: 63022 - protein, 73 aa, Sorghum bicolor
  Clone ID: 18069024.pep
QSICGCCTLICSLPQPLPGNSKVAVAKNCSPPQPRPDSKAAVAIWNPSFIHWFSHVNINIIIDLGVPLRFRVL

SEQ ID NO: 63023 - protein, 175 aa, Sorghum bicolor
  unsure (1)..(175): unsure at all Xaa locations
  Clone ID: 18069027.pep
CEGLTARGTYYINVEKLGHGAHXRRTYGQQVYSPFLLAFTHEDATSAKSYNVAKATMMDVNYSLPDNVAIITLQNLDDGTTLLRLAHLFQAGEDPKYSVVAKVDLKKVFGRRTIKELTETNLSANQKKSEMKKLKWRVIGDMENGTTSVKGGPVDCRALVVALGPMEIRTFLLRF

SEQ ID NO: 63024 - protein, 46 aa, Sorghum bicolor
  Clone ID: 18069032.pep
LNLPITTIIMGCILAKHKPNCLKKAIMQGAIPPGNNLTQNFPPQSY

SEQ ID NO: 63025 - protein, 152 aa, Sorghum bicolor
  Clone ID: 18069053.pep
KIIDFERWRYLATKPGFASLNGESVNSITDSRHKRFMDVQANTYAFGVILLELISGRASVSKDTGGLVDWARKHLEQPEEFSKLVDPRLQSVNQESLGIVCNVVNLCIDPEPSRRPSMSMIAAILEEGIEASAATMLRNSSLAWAEAELAIS

SEQ ID NO: 63026 - protein, 50 aa, Sorghum bicolor
  Clone ID: 18069068.pep
VYFCVPETKGKTLDQMEMMFESGDEWGGGEIELEDTQHLMPSNKKSVPLG

SEQ ID NO: 63027 - protein, 39 aa, Sorghum bicolor
  Clone ID: 18069087.pep
FSLQVLHLIGGKPNLMNQLQLKDGPEWDKVASIPIKQIR

SEQ ID NO: 63028 - protein, 109 aa, Sorghum bicolor
  Clone ID: 18069089.pep
KHKSSKLYSLAKFLQFSSPFYSNQPKSSTTMSSNGSLPPTSLSLKCEGGATSKLPAPVLSSLARFSFRFRGRHLLRLKPIDVPCHTRPQNSALTINLPRFLYNLGVDTL

SEQ ID NO: 63029 - protein, 128 aa, Sorghum bicolor
  Clone ID: 18069122.pep
GKQTRCISRRQILESYQAYGDSIIDQYGPSRPNVRQLVKPLLNLFHSEPGNSLWKRKADSALRHCKTVKTFLEETLDAIPDSVLDKPVNREPCSDEGYFANIDSLLPPKYTTPINCSYGRLELVAAST

SEQ ID NO: 63030 - protein, 122 aa, Sorghum bicolor
  Clone ID: 18069131.pep
EGCAPPPAPRSEVLKNTRVKFNLYPGTSLGGGGGGASGSGGGGTAGGHDGHSREAMLLGYVVESPSSSDSSSDSDSSQPDSPCQSDLFAEPTLRVSTSDTVSQVPETPLGSGETELVPAYNY

SEQ ID NO: 63031 - protein, 55 aa, Sorghum bicolor
  Clone ID: 18069145.pep
PVEMYIKQRRVPRGSTKWLCLQTLSVTCLLVSIAAAAGSIADVVDALKVYRPFSG

SEQ ID NO: 63032 - protein, 95 aa, Sorghum bicolor
  Clone ID: 18069149.pep
HTTISIRDMSFRYSHVNDTTPFRNCFHHQIAMVAELRHKQNIPEMHTEAQNAYLYALESDLLKQQSQDIPGRSKVYQQMSLMQYLLQQNIDLDLG

SEQ ID NO: 63033 - protein, 95 aa, Sorghum bicolor
  Clone ID: 18069152.pep
TYLWGKDAEEFKPERWLVNGVFQQESPYKFAAFNAGPRICLGKEFAYRQMKIMAATLLHFFRFKLEDESKEPTYKVMFTLHIDESLHLYAYPCSA

SEQ ID NO: 63034 - protein, 115 aa, Sorghum bicolor
  Clone ID: 18069212.pep
RPIDRVNSYARILDEMDALDVSTCTCILLLMNYMLGTSNHRWSSHMDLPPWRHGQNSNCSASTLLQLFLTAPDTAPYMCSCLRNEMHFHPETPRGLLHLEQTDISQHETIIADEL

SEQ ID NO: 63035 - protein, 149 aa, Sorghum bicolor
  Clone ID: 18069227.pep
FPFMMGTIPPESWVLEKQLDLISNTSILWTDYGLRSLSRTSSIYMKRNTEHDPPYWRGAIWINMNYMVLSALHHYAHEDGPYSSRAGELYDKLRSNLIRNIVQNYNETGFFWENYDQKNKGKGKGARSFTGWTSLIVLIMAESYPTLHR

SEQ ID NO: 63036 - protein, 94 aa, Sorghum bicolor
  Clone ID: 18069257.pep
QEALKALWHATYPDQELQGLISEQWKDMGWQGRDPSTDFRGAGFISLENLLFFAKTFSASFQRLLKKQCGNRATWEYPFAVAGVNITFMIMQML

SEQ ID NO: 63037 - protein, 47 aa, Sorghum bicolor
  Clone ID: 18069261.pep
AKTYKMPTPPWGGTYHLVAPHQTLASSLGFFKAQINLLPIAPHKKTP

SEQ ID NO: 63038 - protein, 134 aa, Sorghum bicolor
  Clone ID: 18069273.pep
TQIGLLPATYPKAIIDLIQFIYCYIGIENTPTKKMTPMNLIYSSGIFFSFSYELFFLPNKTCARNELLDCLDHQATTHSTLLVIPQKPLRTSIRREVLIFNMVHAYPSTNVVSWLSPNFFHLHASYGITLVPRL

SEQ ID NO: 63039 - protein, 143 aa, Sorghum bicolor
  unsure (1)..(143): unsure at all Xaa locations
  Clone ID: 18069289.pep
LAIRDMSSSDPYVVLTLGQQKAQTSVINGNLNPVWNEELXSVPQHYGPLKLQVFDHDMVSKDDLMGQAEIDLQTMINAAAAFGDPELLGDIQIGRWLKSEDNALVRDSAVVVSGGKVKQGVALKLQHTESGELELEMEWMPLV

SEQ ID NO: 63040 - protein, 134 aa, Sorghum bicolor
  Clone ID: 18069304.pep
PGRNEDSILYSVSILRATPFIEDLEVHFGGTTSLWLADVGPRRQDIGQCNPYNRLKKMWITGFKGVRGQVEFMLHVVENAPALEVLTVDTHKRSTSGGDSWTKKSGPPPFEEAKRIALTCLSRAISLSTKLDVI

SEQ ID NO: 63041 - protein, 109 aa, Sorghum bicolor
  Clone ID: 18069316.pep
DVKMGYRRLKEKVKEYKRRDAKLYGNMISKLSKLEDTEDNDQMSQALNKKHGLLWPLTEMLRRFFTTDGSKGSTLWLVLRLLIPVMLLVAVCVGYYMHSSVQEIDCINC

SEQ ID NO: 63042 - protein, 62 aa, Sorghum bicolor
  Clone ID: 18069326.pep
DARDILGLLPTWKLLLDTKLPILITARIYLSLYGWTEYIYLTLHDYLHYIFFPHLLPILMGN

SEQ ID NO: 63043 - protein, 142 aa, Sorghum bicolor
  Clone ID: 18069373.pep
AVERNPDLSTALIAMGQTLFSNKLFPEAAVCFEHAIPKIQEDDPLLVLAYFGAGLSNERQGDNETAIKLLQRLAELKEPKKPINKTCYFQGMLTLGSILSREGRNSEAAKYLRMAIAYDPAVERLLKECEEGMDDQPKPEEK

SEQ ID NO: 63044 - protein, 133 aa, Sorghum bicolor
  Clone ID: 18069387.pep
LEESIRTFMAFLRADKRSHYEMFREMVKRRASARSAVDQTLVVTLKKANKKKKSRLKDLTRPRRCLKRTRLREEEELSILLGLIDLKVVARVLRMPEITDQQLHWCEEKMNRVRIDLEGKLQRDPTPLFYPAH

SEQ ID NO: 63045 - protein, 36 aa, Sorghum bicolor
  Clone ID: 18069411.pep
TKLCCTTNAYTSFISGSLISPLLMGEGSPAPPIQIC

SEQ ID NO: 63046 - protein, 48 aa, Sorghum bicolor
  Clone ID: 18069431.pep
RLTRMMWFCQTPLMRRHQAAYDEIMSSVGPEHGGLFFGDGPNGPGKIY

SEQ ID NO: 63047 - protein, 59 aa, Sorghum bicolor
  Clone ID: 18069455.pep
TMRSINLSLVQNVYSCMICDCRNIKPEYPRHQPKHFNQNFRVGGVVNINNPNYKQMSAK

SEQ ID NO: 63048 - protein, 137 aa, Sorghum bicolor
  unsure (1)..(137): unsure at all Xaa locations
  Clone ID: 18069461.pep
MHYSLLCVQAPSCYNSFLHSARNVCRRVGRAHDVIIVQHEAAAMRHITNAAGAVFQDSEAARVVCGGAVATVENRLNDTEXVVNLLSCSLRDHRGDVGQVVPVLDASRREQRLLEFDDVFSSGGTVLEHDKTTRLRN

SEQ ID NO: 63049 - protein, 99 aa, Sorghum bicolor
  Clone ID: 18069469.pep
KISMLLCTNHKAPLKHHHYLLSSRRGLPVWRLKGIELIFSATPSFFFCIDVIGCEPTLSSGVMLWYASEHSRELKWSLNNKQKSSYSLRPCSLISFCIG

SEQ ID NO: 63050 - protein, 88 aa, Sorghum bicolor
  Clone ID: 18069478.pep
YAHHSSSISPKQSILPPEEARKSEPLGVQPITLHFCRADLHDLPSQWIGTLGFLYHLHFCASELSCLTTGAPTPASFGGIVVWLTPGA

SEQ ID NO: 63051 - protein, 94 aa, Sorghum bicolor
  Clone ID: 18069502.pep
ANKYRKAKRIFASNRNRISNESRSWCCFEFSEMVLLHDKSRFSFQKYPPKLQNAIMRKIEPFLHILKGTSCSYKLQSCAYHEEDRTVSTYTEGH

SEQ ID NO: 63052 - protein, 128 aa, Sorghum bicolor
  Clone ID: 18069524.pep
VSQEKMEHVSIFTDPSDLRKMQGQQHHKMKRVTIQGFTSAKSLVELTCHFVESITSLEHLTVEAFQSSIRCSMPARKRRKCFPLPIDVLREAQRGLLAIRTYIEPKVPSMVKLRVIEPCCRCHAVVEL

SEQ ID NO: 63053 - protein, 70 aa, Sorghum bicolor
  Clone ID: 18069542.pep
TSSEPGPTAAAVSSGATAITNISWILSIIRHGVLSACAAAAISVCPTTVIPMVAMAFMGLKATPFVNFVH

SEQ ID NO: 63054 - protein, 96 aa, Sorghum bicolor
  Clone ID: 18069548.pep
GIRRFSKLKITGKMDSSQGTFQHVFDCSRQHFITDWQIFKRMCGPSQSYYKSIMHSRSQASSIKTSVESTVARIHSRNRLMWLDSTFSPERGRTEE

SEQ ID NO: 63055 - protein, 73 aa, Sorghum bicolor
  Clone ID: 18069551.pep
ESIGSMGGVDELNFHLSSLASFNTNKFYIDSRVLLEPLEPLTSGLIPQNLPNIPHKDNTYLAFSFSKKISTYL

SEQ ID NO: 63056 - protein, 93 aa, Sorghum bicolor
  Clone ID: 18069612.pep
GNHYHSSYHSNNGLEEGNRERDQRDNSPQTMSKTSFMDDDPDLEEGQSFHFTDVPPNNDGNEDEDDGNRVGSICSSMLANLHVRIVPRSSDPV

SEQ ID NO: 63057 - protein, 147 aa, Sorghum bicolor
  Clone ID: 18069653.pep
KGKEQRGSVNGNCFHARDNHIALTVLGRWVHAPRMQRSATALDGAMHACSFNGQCKKIKKEVGLHGKPVDAKDNYIVLDGGRMHPACKGQLQLWTVACMYVHLMLDSCMHLCVLCNAYAEPCIELPAMAFMEAVLYVGHGGTLSFKP

SEQ ID NO: 63058 - protein, 138 aa, Sorghum bicolor
  Clone ID: 18069660.pep
KAAKDTKPLFAALKKEGKSIAVGGYCWGGKFGAEIAKTNDIKVVCLSHPSTVTAEDMKEIKCPIEILGAQNDTSTPPKLVYQFVSALRQRNEIPYFAKIFPGVAHGFACRYNTTDPLAVRTAEEALAYMLDWFKKYLK

SEQ ID NO: 63059 - protein, 99 aa, Sorghum bicolor
  Clone ID: 18069703.pep
VFHMMDPDGIANWSVTHVDWSEGKWHPKAYRAKDVTFELLKNITSIDMNHHVTSDSKKVVTEKPCLWNGAKRPCYLFARKFYPESINNLLTLFANYTLI

SEQ ID NO: 63060 - protein, 47 aa, Sorghum bicolor
  Clone ID: 18069747.pep
YWYTIIPKPFLELGKTWGCIPPKNFPPFLRKLWIPREKNHSTGNVFY

SEQ ID NO: 63061 - protein, 49 aa, Sorghum bicolor
  Clone ID: 18069752.pep
SLPDDSFNLQCYMPSPFPDRTEGSHSFGKVVVGWLKIKAAIRWGILVRK

SEQ ID NO: 63062 - protein, 103 aa, Sorghum bicolor
  Clone ID: 18069759.pep
RIPLCPSDDEMFPFQFKRKQFPIRLSFAMTINKAQGQTLPNVGVYLPEPVFSHGQLYVALSRATARSNNRILVIPPSDKKDKKKTTKTNGAYTKNIVYKEVLT

SEQ ID NO: 63063 - protein, 68 aa, Sorghum bicolor
  Clone ID: 18069760.pep
MREQKNTLLDSEKLDSARKRLQENYQEAQNAKKQRTIQVMDIHDIPKPKNRNTFIRKSGGGGFPAKHR

SEQ ID NO: 63064 - protein, 37 aa, Sorghum bicolor
  Clone ID: 18069779.pep
LGIFPVRRPFPFFLCIMYRAQILFGGSHILIFRGLAL

SEQ ID NO: 63065 - protein, 52 aa, Sorghum bicolor
  Clone ID: 18069783.pep
GISMVSRDSQGHTSKSGVHTLQGIQKNWCLPLFLRSGGLLPITGGLGFNFPG

SEQ ID NO: 63066 - protein, 55 aa, Sorghum bicolor
  Clone ID: 18069797.pep
GLRRGQFIFALKETYFGQLTHTSLSMGESFVLKPRWFVFFVLRLYDEKVPIWGLI

SEQ ID NO: 63067 - protein, 49 aa, Sorghum bicolor
  unsure (1)..(49): unsure at all Xaa locations
  Clone ID: 18069830.pep
IAVPAGXDKEGVPFAIYFGGLKGYDPRLIEIAYAFEQATKVRRPPSFKS

SEQ ID NO: 63068 - protein, 70 aa, Sorghum bicolor
  Clone ID: 18069870.pep
QLIFPSTGIFWTAVNCFLRHFLSHFHPFGCEQKGSIQTNRAIILLVEAQANFAMYIFVNNTFVARTQISI

SEQ ID NO: 63069 - protein, 121 aa, Sorghum bicolor
  Clone ID: 18069881.pep
LVHRWLSPRVLAYWFMFGGFRLQSGDIVLKVSGGNIDGVERIVKSLQTQSLTCKVKRKGRFFWIGFQGSNGDSFWKIVEPYVLDSFASSTEESHNVGSDGLQDSDTYYDDDTQRHDRESDE

SEQ ID NO: 63070 - protein, 87 aa, Sorghum bicolor
  Clone ID: 18069887.pep
RRPVELKRTPDERITIRWTFKKFNEGNMREILDPLLEDHVDDEVLEKLLSLAFQCAAPTRDDRPTMKEVGEQLWEIRKEYGKSIRKV

SEQ ID NO: 63071 - protein, 85 aa, Sorghum bicolor
  Clone ID: 18069896.pep
ANPVEMTPARISHFQMLFETLLQKDDSRVWNVFTRVAGLPELEILRDGIVLFIKQHVIAEDTGKDLAGKFKIAKKALDNTAGVLM

SEQ ID NO: 63072 - protein, 81 aa, Sorghum bicolor
  Clone ID: 18069946.pep
PPIASIKFFKDFGCDEKFPITDDRVSHLLPAYNEDRIVRVYAKKPELVDVVSEAFENLQMRMYGEKTQVHETPKKKRIRSN

SEQ ID NO: 63073 - protein, 62 aa, Sorghum bicolor
  Clone ID: 18069978.pep
YMIGAPKRQPKHKNSFKLQLAKNYRGLTKKFNFSQSQGSPATNQNPKKPSSVALSFSKVSKY

SEQ ID NO: 63074 - protein, 147 aa, Sorghum bicolor
  Clone ID: 18069980.pep
AKIGASAYKLQLPPHCLIHPVFHVSLLKKAIPPHTTVSSALPDNTDELQVPQDILDRRLQHRHGTTVSQVLVRWSYLPDDLCTWEDEVPLRQQFPRAPAWGQAGSKGGGDVTVPSTPVPTLKQDTSSAQEKRSRRPSSRTSGPEWTQ

SEQ ID NO: 63075 - protein, 34 aa, Sorghum bicolor
  Clone ID: 18070006.pep
HAGFPREDHFNLGQWLVSSVLKFLYLLSKYYMRI

SEQ ID NO: 63076 - protein, 55 aa, Sorghum bicolor
  Clone ID: 18070009.pep
LLLYQVCSTLKLCCTYSWKKGIKGKEKAYSMHYQVIDLLILRKKRFADSCGWLTM

SEQ ID NO: 63077 - protein, 107 aa, Sorghum bicolor
  Clone ID: 18070013.pep
PEASSLLIHSLVPWCHVHVVFGHLGLASRMEVRQRFEGGCLIPFRSRRFSPAASWLQFFMRMGAIFFFFSSILLFVYLFSSCWWWAVRFSPFGVTNQCSSLGYIVLD

SEQ ID NO: 63078 - protein, 119 aa, Sorghum bicolor
  Clone ID: 18070014.pep
QDDELESFLYDDCGPDKNEVNELDKYMAEPLLKQNPFDILAYWKNNTDKYPILAQIARDMMAIQVSTVASESAFSGAGRVVDPHRNRLDPEMVQALICAKDWIHAASKDPKTFLQLWLN

SEQ ID NO: 63079 - protein, 111 aa, Sorghum bicolor
  Clone ID: 18070029.pep
GNQLVTTHIRDKIVRNECGKEERQGRRNRIPLLAPASHLAYQPCFQQEPLLYSDFLHQSKGKKHYLCMNNLCNYTEKLKHEMGGKGKSSAEGKIISQQCKQANALTLFLPK

SEQ ID NO: 63080 - protein, 66 aa, Sorghum bicolor
  Clone ID: 18070048.pep
QHYVAITLLCQTDIVLPNLYSLYNYCIVVVMLLGHGSPPIAFPLITVTNAPLRSISWINCLTSGSR

SEQ ID NO: 63081 - protein, 145 aa, Sorghum bicolor
  Clone ID: 18070050.pep
SVCPSLVLRGIGETIASRSVPKVLLLNGSHDRETAGLSASGFVTAITDSLNRTYGDPHKRLKNHPNDYVNAILVPEGGQVPIDIENLSVQGIFHVVTVKSIHDPKVGAIFDARSLIQALTILISEQMDMCLSERGHLTENVKVVN

SEQ ID NO: 63082 - protein, 72 aa, Sorghum bicolor
  Clone ID: 18070061.pep
QHSAMITLKFNSHDSFSNSPSLLKIVQLNLICSYFWEILSLEPDGGCIVINDGFDHCNQLTTTIVKSSCWEL

SEQ ID NO: 63083 - protein, 41 aa, Sorghum bicolor
  Clone ID: 18070068.pep
TKEPPKIFVYLQLHCLHTTLSFSATGKCFQLMGPLYLKLHS

SEQ ID NO: 63084 - protein, 83 aa, Sorghum bicolor
  Clone ID: 18070073.pep
LCTININIFYIYLVKVISRETQIILIFRRREYVSMAIFVCCSYSFQMFQLFYLDVALFYLDIAYVAVPIYVCCKCMFECVKCV

SEQ ID NO: 63085 - protein, 94 aa, Sorghum bicolor
  Clone ID: 18070089.pep
GNQVWFQCVSGLQFDLVHRTEQVHLAADTSLTFWCDSCCGYAALEVVKRILGVHSFFLIFGSSWLIFFTGTVLELLGLWFYHVGKVAKCVHVEI

SEQ ID NO: 63086 - protein, 67 aa, Sorghum bicolor
  Clone ID: 18070114.pep
FYEPSCSQQTGGKAAISYQCKSSWFKVSNDRYNTSGSKVRSRNVLSHKSFSSRYSNRLGEKWMNPVL

SEQ ID NO: 63087 - protein, 56 aa, Sorghum bicolor
  Clone ID: 18070123.pep
LLQCSTSPAAEPPHFVENERRIWKYLINNPDWEETFPKHRPRVFHRTSDGSWSRYS

SEQ ID NO: 63088 - protein, 75 aa, Sorghum bicolor
  Clone ID: 18070125.pep
QGFQLPIIKGFSVIDAYVLTSYSRMIVSCNVAFPEPEVLSPIQESKTNEDLSHEVGLLIGSAKTWQPPITSVKFL

SEQ ID NO: 63089 - protein, 62 aa, Sorghum bicolor
  Clone ID: 18070145.pep
QSILTYLYTLQANIYTYYVSGYTKNLITKSLQMYGEAEKLKNRYNILLTIWQVFPAGTFRNQ

SEQ ID NO: 63090 - protein, 74 aa, Sorghum bicolor
  Clone ID: 18070195.pep
LQMAPSMMDAAGIDVMDSIADVYGDAKPMMSGDSTGSKGGFDVKLERPSPRRPHMGGSPSVIGGGQQTRNLSYG

SEQ ID NO: 63091 - protein, 98 aa, Sorghum bicolor
  Clone ID: 18070227.pep
ELEMLEELDISSNQIRVLPDSFGHLSKLRVFHADETPLEVPPKEVVKLGAQELVNYMKNMVAAREVSQNQTNKRSFWTWFVSLFGCCKKNEGLGPVPV

SEQ ID NO: 63092 - protein, 73 aa, Sorghum bicolor
  Clone ID: 18070251.pep
VLSIYKRGGRIMVFGNYNFTKVHDTKELNTPPPYRTQKKIKCWTNAAPEHKKTSPDADKLIFSILEQPCSVIN

SEQ ID NO: 63093 - protein, 53 aa, Sorghum bicolor
  Clone ID: 18070271.pep
TSPPYQFKQIINSQNVLRDCTFTLYKDYKIYLFPLHRKHPWKSLFSLKKKGWH

SEQ ID NO: 63094 - protein, 67 aa, Sorghum bicolor
  Clone ID: 18070280.pep
SHPCCLTKEDCAKEEPTEETEAKETENQLITKLKCYLCYCDREIVSGPYVIIFETMYLDPMLLYLDN

SEQ ID NO: 63095 - protein, 34 aa, Sorghum bicolor
  Clone ID: 18070301.pep
CSCCFQSKKNWIDMSLITPKSLPLFKLQKLIIPK

SEQ ID NO: 63096 - protein, 75 aa, Sorghum bicolor
  Clone ID: 18070311.pep
TTRIGKYLGGNCYMMPRCPDFVLSCFCTLTDNVSFLFVIPLIDRGCRVVTMVSFTVIMRLNKIHLPINRMELFDP

SEQ ID NO: 63097 - protein, 103 aa, Sorghum bicolor
  Clone ID: 18070316.pep
MDARLSALAGWFDVHFRGSAQNPGVEEIELTTAPDEHGGTHWGQQVFLLTPPLSVTKGDNVNVSFSMVRSKENHRLMDMEFTYELHELSGRKHPAVTTKMYLE

SEQ ID NO: 63098 - protein, 84 aa, Sorghum bicolor
  Clone ID: 18070361.pep
LSYINPSGQFFLDCCLFPGVRLFSVTEALALFFGEASPAKGGELFLAEESAAEDGEFPFSLLFLSREKISGFANDLVHGHLLDR

SEQ ID NO: 63099 - protein, 94 aa, Sorghum bicolor
  unsure (1)..(94): unsure at all Xaa locations
  Clone ID: 18070418.pep
SEKYMKKKGGRKICXFMVKEEKQENRGSVEFQVFSFTNKIRRLASHLELHKKDFSSERGLRRLLGKRQRLLAYLAKKNRVRYKKLISQLDIREK

SEQ ID NO: 63100 - protein, 199 aa, Sorghum bicolor
  unsure (1)..(199): unsure at all Xaa locations
  Clone ID: 18070437.pep
GPPLEDCFXYFKGCQGCQKFAXIQRAPASAMNPIIMPWSFREWAIDLIGQIYPPSSKGHKFILVATDYFTKWVEATPLKKVTSANMIEFVKEHIIYEFGIPQTITTDQGTMFTSGEFDEFAIGMGIKVLNFSPYYAQANGQAEASNKGIIKLFTRKIEENPRRWHTLLGDALWSYQMACNGSIKVSPYQLVYGHDAVLP

SEQ ID NO: 63101 - protein, 59 aa, Sorghum bicolor
  Clone ID: 18070456.pep
ICPAPREQRARQRILESWLAPPAPRREVLATSQLSLRSPIFPGDRRLRFFLGPERSLFP

SEQ ID NO: 63102 - protein, 64 aa, Sorghum bicolor
  Clone ID: 18070458.pep
HYSCCEFLFCVVILLPALGLCPASAVVPLSMDQTLWSDIGNVILFVRTQMQHPRVAIVALHNLN

SEQ ID NO: 63103 - protein, 71 aa, Sorghum bicolor
  Clone ID: 18070462.pep
KFTPKVSLPKGKKRKGNQVSNTMYRTISHLLTYAQSYNKNTKGNITKQNQHGNDASWLLLICPTTKVSRRG

SEQ ID NO: 63104 - protein, 89 aa, Sorghum bicolor
  Clone ID: 18070466.pep
TPFAAPQLIQHNSPVGSPSNGQTANQAQLSVNHQQPKDSSAASTRPYYIPDNLFSDLIDVKSFGGGNKMGGPTTMGSSNGGQPMIGGKK

SEQ ID NO: 63105 - protein, 101 aa, Sorghum bicolor
  Clone ID: 18070496.pep
HWAMFFRDELLSWSWRRPLGIPSVPVAAGMINPSDFQQKVVNNVDHVVNRIKSISPHYLAEEEENATEPPQSVQRGVTELVESALSSRNLCMMDPTWHPWF

SEQ ID NO: 63106 - protein, 92 aa, Sorghum bicolor
  Clone ID: 18070498.pep
TRKKPVFIDDAGMKQSLAHYFIEGLQEGALMEIIDQQILEEADQGEIDDIALLAQACLRTKGVERPTMKEVEMKLQLLRTGRLKKKIPFTGK

SEQ ID NO: 63107 - protein, 94 aa, Sorghum bicolor
  Clone ID: 18070518.pep
EVLPELENILSRVTVSLKLENILAPSHFFCPILQEIMEDPYVAADGHTYEHRAIKAWLEKYKISPVTNQRLPHLSIIPNHSLHAAIQQWKLRAS

SEQ ID NO: 63108 - protein, 103 aa, Sorghum bicolor
  Clone ID: 18070521.pep
NFSFTQTCCSTILQSFMEFSPHRANRIFLTLQDVFIEAMKVKGSNKYELPHMKKETLERQDRLPSCISWDPLLLQEAEATLALLCRPPQSAASRDSALQNVRN

SEQ ID NO: 63109 - protein, 58 aa, Sorghum bicolor
  Clone ID: 18070523.pep
MVWGHPCPMCGRRNEKFGTNNHILCMGCRGHYCALCRKRVTKSSEHYGPRGCQQHTDP

SEQ ID NO: 63110 - protein, 66 aa, Sorghum bicolor
  Clone ID: 18070524.pep
YMAHLSLSQSFLVLVPKLTVRSLQSFYTLSSLLSSTSAFSQLTAHHNTCSKLTTRFYSFFSTLAFS

SEQ ID NO: 63111 - protein, 58 aa, Sorghum bicolor
  Clone ID: 18070535.pep
FLMDHQKMALCGPRLVSAWLACFCLELSLTLKSSELAITPTELKPIRAPAIDGVSIVP

SEQ ID NO: 63112 - protein, 54 aa, Sorghum bicolor
  unsure (1)..(54): unsure at all Xaa locations
  Clone ID: 18070543.pep
TTNPNLNVVYSTLVLCAPSTPVQVKQGLATPNSSEXQHVHIXRFPYNILYSSVM

SEQ ID NO: 63113 - protein, 67 aa, Sorghum bicolor
  Clone ID: 18070563.pep
STYKSQQQLAKGWLLYKKLNKLNFSIMACCPSVVNTTLFGLLKEFSCIILLAVRTVTLDPFALTPTS

SEQ ID NO: 63114 - protein, 99 aa, Sorghum bicolor
  Clone ID: 18070583.pep
SVQEMKDRFVAVGLGPRQLAVMSAFLGPDQAATEERLIADPDCRPWVEKYQRSRETVSRTDYEVDLITTLTKLSSFGQNINYEAYTYPKQKIDLGKLKL

SEQ ID NO: 63115 - protein, 40 aa, Sorghum bicolor
  Clone ID: 18070591.pep
KNPPVHPTLNPKNVGPPTSFLSGGITYTKKTFCHGPRGKR

SEQ ID NO: 63116 - protein, 101 aa, Sorghum bicolor
  Clone ID: 18070627.pep
NCQDRTIVLGNYIFNTVDQITSLQDLHHKYNGCKSAEYQRAKGRGTEASAHPSTQTDVHNGTRALQYGDLSRFPPRPSHLWTGMQYAATTSDIVATDIVVT

SEQ ID NO: 63117 - protein, 100 aa, Sorghum bicolor
  Clone ID: 18070670.pep
IYHYWQDLNEDRKLWKLGTLPPGLITFYNLTYPLNRTWHVLGLGYDPAVDIAEIDNAAVVHYNGNYKPWLDLAISKYKTYWSKYVDVDNSHVQHCYEGKQ

SEQ ID NO: 63118 - protein, 78 aa, Sorghum bicolor
  Clone ID: 18070691.pep
RLVRQYTEADLYRQLSYFCYVLDATRCLEKLDQKARLPFEREFVAVGQTINLALQEIQKIRDRCAFGWVQLKDLAVSI

SEQ ID NO: 63119 - protein, 78 aa, Sorghum bicolor
  Clone ID: 18070695.pep
GRVTIASVKNFQLIAATTPPPAGAPTPSQPAPSDPDKVILQFGKVARDMFTMDYRYPLSAFQAFAICLSSFDTKLACE

SEQ ID NO: 63120 - protein, 108 aa, Sorghum bicolor
  Clone ID: 18070701.pep
SRGTSQRSLPGSETCTYAKNIIWCYASMVNGSGQMSEAAQSSLGRFLQATILDDEHQYEHQDWPCLPFVLDDASRRMPMLMSVVSLSLLFSSFNFCFFFEEPLGFHFF

SEQ ID NO: 63121 - protein, 73 aa, Sorghum bicolor
  Clone ID: 18070702.pep
VRESANRDSPRRAALVLLPFFLLNLHNCLIPANFYLPFHLFTLILSKSSTVLSNGVIFLVIIIVITSIREKKI

SEQ ID NO: 63122 - protein, 98 aa, Sorghum bicolor
  Clone ID: 18070741.pep
RFTVSRKNLKGKELKDAASWLSLAPPVSHDEPNLKGSNITWMHSQITPSVPAHSVGLIFEPSFSGMLVPRAPTPCLPLFPIASTRDKQQMLMAIANSS

SEQ ID NO: 63123 - protein, 154 aa, Sorghum bicolor
  Clone ID: 18070766.pep
LWTVNRLGTSDNIPNIRFENLRRLELVNLPWLKKWVVHAPCQLFRFLEVLIISGCSQLEELSFQHLACCQQRKEPNVNSFPRLMKLKIKECPQLLSFPPIPWNKALCPINIEGIGSSCLDKFVCEKRFFSPEYDLTIEGKDTIFVYERKKDTIH

SEQ ID NO: 63124 - protein, 55 aa, Sorghum bicolor
  Clone ID: 18070777.pep
ETKTLKQAPRNILLLSPVILNTTRNVLLKECQMRQSRVQCQFIMYNTPHTKSTHD

SEQ ID NO: 63125 - protein, 113 aa, Sorghum bicolor
  Clone ID: 18070787.pep
WLAASTKTRHMIDDGQYIGLFKIIQATKNRVWYEIPQSCPRVRPPLERVLDRSETRLGDDEVDSRTLSLAVFLVLEVTKERLPWVSLFTDESAVPSLADEWPAGVFPLTDDEN

SEQ ID NO: 63126 - protein, 67 aa, Sorghum bicolor
  Clone ID: 18070823.pep
AVPVHGRDVDKLQHQGYGTLLMEEAERIAQKEHRSKKLAVISGVGTRHYYRKLGYELEGPYMVKTLA

SEQ ID NO: 63127 - protein, 29 aa, Sorghum bicolor
  Clone ID: 18070844.pep
LQESTSMGAHELLDICGKSRNLKINVYIV

SEQ ID NO: 63128 - protein, 60 aa, Sorghum bicolor
  Clone ID: 18070845.pep
SYLSIFKSTVHADKLCSEKLILFTPPSGLLRRCDDLCRGHHRKYIQLNSYNVLTTFAMAI
